United States Patent 12,281,301 (SEQUENCING-BASED PROTEOMICS) - sequence listing, part 3

SEQ ID NO: 54234 - DNA, 70 bp, Artificial Sequence
  Synthetic
gccaagcatttaggtgacactatagtgaaaggcattggtttatgagtttcagagctatgctggaaacagc

SEQ ID NO: 54235 - DNA, 70 bp, Artificial Sequence
  Synthetic
gccaagcatttaggtgacactatagaagactcagctagacatcacgtttcagagctatgctggaaacagc

SEQ ID NO: 54236 - DNA, 70 bp, Artificial Sequence
  Synthetic
gccaagcatttaggtgacactataggagtctctggggttgaaatcgtttcagagctatgctggaaacagc

SEQ ID NO: 54237 - DNA, 70 bp, Artificial Sequence
  Synthetic
gccaagcatttaggtgacactataggcaacgccccccgggaatgagtttcagagctatgctggaaacagc

SEQ ID NO: 54238 - DNA, 70 bp, Artificial Sequence
  Synthetic
gccaagcatttaggtgacactatagtgttggggagaatttcaaaagtttcagagctatgctggaaacagc

SEQ ID NO: 54239 - DNA, 70 bp, Artificial Sequence
  Synthetic
gccaagcatttaggtgacactatagctccctgcatgatacatctggtttcagagctatgctggaaacagc

SEQ ID NO: 54240 - DNA, 70 bp, Artificial Sequence
  Synthetic
gccaagcatttaggtgacactataggtgcgtgaccctcgcctaaggtttcagagctatgctggaaacagc

SEQ ID NO: 54241 - DNA, 70 bp, Artificial Sequence
  Synthetic
gccaagcatttaggtgacactatagctgtcggaactcattgctgagtttcagagctatgctggaaacagc

SEQ ID NO: 54242 - DNA, 70 bp, Artificial Sequence
  Synthetic
gccaagcatttaggtgacactatagcccctactggggcctcagcagtttcagagctatgctggaaacagc

SEQ ID NO: 54243 - DNA, 70 bp, Artificial Sequence
  Synthetic
gccaagcatttaggtgacactatagtgctgcagagaatggttttcgtttcagagctatgctggaaacagc

SEQ ID NO: 54244 - DNA, 70 bp, Artificial Sequence
  Synthetic
gccaagcatttaggtgacactatagccactcggggttcattgtgcgtttcagagctatgctggaaacagc

SEQ ID NO: 54245 - DNA, 70 bp, Artificial Sequence
  Synthetic
gccaagcatttaggtgacactatagggtggcctgtgctgaaaactgtttcagagctatgctggaaacagc

SEQ ID NO: 54246 - DNA, 70 bp, Artificial Sequence
  Synthetic
gccaagcatttaggtgacactatagaaaccagtctgcggtttagggtttcagagctatgctggaaacagc

SEQ ID NO: 54247 - DNA, 70 bp, Artificial Sequence
  Synthetic
gccaagcatttaggtgacactatagtgaagatgatcctgatgaaagtttcagagctatgctggaaacagc

SEQ ID NO: 54248 - DNA, 70 bp, Artificial Sequence
  Synthetic
gccaagcatttaggtgacactatagactatgtagctctcttcaaagtttcagagctatgctggaaacagc

SEQ ID NO: 54249 - DNA, 70 bp, Artificial Sequence
  Synthetic
gccaagcatttaggtgacactatagccacgatctcccggggctaagtttcagagctatgctggaaacagc

SEQ ID NO: 54250 - DNA, 70 bp, Artificial Sequence
  Synthetic
gccaagcatttaggtgacactataggtctcccagcgaggtctgaagtttcagagctatgctggaaacagc

SEQ ID NO: 54251 - DNA, 70 bp, Artificial Sequence
  Synthetic
gccaagcatttaggtgacactatagaccccggctggagtcatgatgtttcagagctatgctggaaacagc

SEQ ID NO: 54252 - DNA, 70 bp, Artificial Sequence
  Synthetic
gccaagcatttaggtgacactataggagagttctctctcctgagcgtttcagagctatgctggaaacagc

SEQ ID NO: 54253 - DNA, 70 bp, Artificial Sequence
  Synthetic
gccaagcatttaggtgacactataggtgtggggaacatcggacgggtttcagagctatgctggaaacagc

SEQ ID NO: 54254 - DNA, 70 bp, Artificial Sequence
  Synthetic
gccaagcatttaggtgacactatagaacatccttggttctactcagtttcagagctatgctggaaacagc

SEQ ID NO: 54255 - DNA, 70 bp, Artificial Sequence
  Synthetic
gccaagcatttaggtgacactatagacgggcaggttggcctagccgtttcagagctatgctggaaacagc

SEQ ID NO: 54256 - DNA, 70 bp, Artificial Sequence
  Synthetic
gccaagcatttaggtgacactatagatagcctccatgactttaaagtttcagagctatgctggaaacagc

SEQ ID NO: 54257 - DNA, 70 bp, Artificial Sequence
  Synthetic
gccaagcatttaggtgacactataggcctgcagcagacacactgagtttcagagctatgctggaaacagc

SEQ ID NO: 54258 - DNA, 70 bp, Artificial Sequence
  Synthetic
gccaagcatttaggtgacactatagtcagcacatatgcaatcatagtttcagagctatgctggaaacagc

SEQ ID NO: 54259 - DNA, 70 bp, Artificial Sequence
  Synthetic
gccaagcatttaggtgacactatagcttctaactcatcgtcacaagtttcagagctatgctggaaacagc

SEQ ID NO: 54260 - DNA, 70 bp, Artificial Sequence
  Synthetic
gccaagcatttaggtgacactataggactagggtcacagttctaagtttcagagctatgctggaaacagc

SEQ ID NO: 54261 - DNA, 70 bp, Artificial Sequence
  Synthetic
gccaagcatttaggtgacactatagctccctcatataacacagtagtttcagagctatgctggaaacagc

SEQ ID NO: 54262 - DNA, 70 bp, Artificial Sequence
  Synthetic
gccaagcatttaggtgacactatagactgcaaagtgtgagaagatgtttcagagctatgctggaaacagc

SEQ ID NO: 54263 - DNA, 70 bp, Artificial Sequence
  Synthetic
gccaagcatttaggtgacactatagcccggctaggttaccagtgcgtttcagagctatgctggaaacagc

SEQ ID NO: 54264 - DNA, 70 bp, Artificial Sequence
  Synthetic
gccaagcatttaggtgacactatagacaggcaccagagaagcaaagtttcagagctatgctggaaacagc

SEQ ID NO: 54265 - DNA, 70 bp, Artificial Sequence
  Synthetic
gccaagcatttaggtgacactatagtaattttcttggtccccttcgtttcagagctatgctggaaacagc

SEQ ID NO: 54266 - DNA, 70 bp, Artificial Sequence
  Synthetic
gccaagcatttaggtgacactatagtaactttgttgtcccacctcgtttcagagctatgctggaaacagc

SEQ ID NO: 54267 - DNA, 70 bp, Artificial Sequence
  Synthetic
gccaagcatttaggtgacactatagtcatagtctttgtaagggctgtttcagagctatgctggaaacagc

SEQ ID NO: 54268 - DNA, 70 bp, Artificial Sequence
  Synthetic
gccaagcatttaggtgacactataggtcacacaggaagacaccttgtttcagagctatgctggaaacagc

SEQ ID NO: 54269 - DNA, 70 bp, Artificial Sequence
  Synthetic
gccaagcatttaggtgacactatagctttagaaacccctacgtgtgtttcagagctatgctggaaacagc

SEQ ID NO: 54270 - DNA, 70 bp, Artificial Sequence
  Synthetic
gccaagcatttaggtgacactatagagcccccagcaagatgcagggtttcagagctatgctggaaacagc

SEQ ID NO: 54271 - DNA, 70 bp, Artificial Sequence
  Synthetic
gccaagcatttaggtgacactatagagcatttgcacacatatgcagtttcagagctatgctggaaacagc

SEQ ID NO: 54272 - DNA, 70 bp, Artificial Sequence
  Synthetic
gccaagcatttaggtgacactatagctgctcgcgggcgggacccagtttcagagctatgctggaaacagc

SEQ ID NO: 54273 - DNA, 70 bp, Artificial Sequence
  Synthetic
gccaagcatttaggtgacactatagaagggccacagctcctcactgtttcagagctatgctggaaacagc

SEQ ID NO: 54274 - DNA, 70 bp, Artificial Sequence
  Synthetic
gccaagcatttaggtgacactatagttcaatctaacacagaagacgtttcagagctatgctggaaacagc

SEQ ID NO: 54275 - DNA, 70 bp, Artificial Sequence
  Synthetic
gccaagcatttaggtgacactataggatgagcaccaacatgtgaggtttcagagctatgctggaaacagc

SEQ ID NO: 54276 - DNA, 70 bp, Artificial Sequence
  Synthetic
gccaagcatttaggtgacactatagtataatctgatggtcacttggtttcagagctatgctggaaacagc

SEQ ID NO: 54277 - DNA, 70 bp, Artificial Sequence
  Synthetic
gccaagcatttaggtgacactatagagatgggccccaggggcctggtttcagagctatgctggaaacagc

SEQ ID NO: 54278 - DNA, 70 bp, Artificial Sequence
  Synthetic
gccaagcatttaggtgacactatagtcagggacagcacaggcctggtttcagagctatgctggaaacagc

SEQ ID NO: 54279 - DNA, 70 bp, Artificial Sequence
  Synthetic
gccaagcatttaggtgacactatagtgccagcctggtgcgagctagtttcagagctatgctggaaacagc

SEQ ID NO: 54280 - DNA, 70 bp, Artificial Sequence
  Synthetic
gccaagcatttaggtgacactatagagacactgactttgggctaagtttcagagctatgctggaaacagc

SEQ ID NO: 54281 - DNA, 70 bp, Artificial Sequence
  Synthetic
gccaagcatttaggtgacactataggttggggctcaagtctcagcgtttcagagctatgctggaaacagc

SEQ ID NO: 54282 - DNA, 70 bp, Artificial Sequence
  Synthetic
gccaagcatttaggtgacactatagggggtgctcaggagtactcggtttcagagctatgctggaaacagc

SEQ ID NO: 54283 - DNA, 70 bp, Artificial Sequence
  Synthetic
gccaagcatttaggtgacactatagttcctggagaagtacgcgtggtttcagagctatgctggaaacagc

SEQ ID NO: 54284 - DNA, 70 bp, Artificial Sequence
  Synthetic
gccaagcatttaggtgacactatagcaagggcccagctgtgcctagtttcagagctatgctggaaacagc

SEQ ID NO: 54285 - DNA, 70 bp, Artificial Sequence
  Synthetic
gccaagcatttaggtgacactatagcaggaacttctcaaagttccgtttcagagctatgctggaaacagc

SEQ ID NO: 54286 - DNA, 70 bp, Artificial Sequence
  Synthetic
gccaagcatttaggtgacactatagttgagcagttcacatctatagtttcagagctatgctggaaacagc

SEQ ID NO: 54287 - DNA, 70 bp, Artificial Sequence
  Synthetic
gccaagcatttaggtgacactatagttactaatatttggaggcaggtttcagagctatgctggaaacagc

SEQ ID NO: 54288 - DNA, 70 bp, Artificial Sequence
  Synthetic
gccaagcatttaggtgacactatagccttccaccggcactcatgagtttcagagctatgctggaaacagc

SEQ ID NO: 54289 - DNA, 70 bp, Artificial Sequence
  Synthetic
gccaagcatttaggtgacactatagttacttcggtcttgcctcacgtttcagagctatgctggaaacagc

SEQ ID NO: 54290 - DNA, 70 bp, Artificial Sequence
  Synthetic
gccaagcatttaggtgacactatagcgacgggcacatggttaaccgtttcagagctatgctggaaacagc

SEQ ID NO: 54291 - DNA, 70 bp, Artificial Sequence
  Synthetic
gccaagcatttaggtgacactatagcttaactccaccttcctattgtttcagagctatgctggaaacagc

SEQ ID NO: 54292 - DNA, 70 bp, Artificial Sequence
  Synthetic
gccaagcatttaggtgacactatagtttgagaaaggggatgtgaagtttcagagctatgctggaaacagc

SEQ ID NO: 54293 - DNA, 70 bp, Artificial Sequence
  Synthetic
gccaagcatttaggtgacactatagctgagctgccaagcctcaatgtttcagagctatgctggaaacagc

SEQ ID NO: 54294 - DNA, 70 bp, Artificial Sequence
  Synthetic
gccaagcatttaggtgacactatagataagtcttctcgcttcagtgtttcagagctatgctggaaacagc

SEQ ID NO: 54295 - DNA, 70 bp, Artificial Sequence
  Synthetic
gccaagcatttaggtgacactatagaacttcacaacttgaccctcgtttcagagctatgctggaaacagc

SEQ ID NO: 54296 - DNA, 70 bp, Artificial Sequence
  Synthetic
gccaagcatttaggtgacactatagcaggcctgacatagcagctcgtttcagagctatgctggaaacagc

SEQ ID NO: 54297 - DNA, 70 bp, Artificial Sequence
  Synthetic
gccaagcatttaggtgacactatagcccgatgacagcttttcctggtttcagagctatgctggaaacagc

SEQ ID NO: 54298 - DNA, 70 bp, Artificial Sequence
  Synthetic
gccaagcatttaggtgacactatagaggaatcgctatcattgacagtttcagagctatgctggaaacagc

SEQ ID NO: 54299 - DNA, 70 bp, Artificial Sequence
  Synthetic
gccaagcatttaggtgacactatagcaagcatcactatggagtctgtttcagagctatgctggaaacagc

SEQ ID NO: 54300 - DNA, 70 bp, Artificial Sequence
  Synthetic
gccaagcatttaggtgacactatagatgacccagtccctgggcacgtttcagagctatgctggaaacagc

SEQ ID NO: 54301 - DNA, 70 bp, Artificial Sequence
  Synthetic
gccaagcatttaggtgacactatagttacagaagttgcttgagaagtttcagagctatgctggaaacagc

SEQ ID NO: 54302 - DNA, 70 bp, Artificial Sequence
  Synthetic
gccaagcatttaggtgacactatagctcagcggcagcgtctggcggtttcagagctatgctggaaacagc

SEQ ID NO: 54303 - DNA, 70 bp, Artificial Sequence
  Synthetic
gccaagcatttaggtgacactataggacggccttggactgaacgtgtttcagagctatgctggaaacagc

SEQ ID NO: 54304 - DNA, 70 bp, Artificial Sequence
  Synthetic
gccaagcatttaggtgacactatagtcggccgccgggctgctcacgtttcagagctatgctggaaacagc

SEQ ID NO: 54305 - DNA, 70 bp, Artificial Sequence
  Synthetic
gccaagcatttaggtgacactatagctgtcccctgaagagtttatgtttcagagctatgctggaaacagc

SEQ ID NO: 54306 - DNA, 70 bp, Artificial Sequence
  Synthetic
gccaagcatttaggtgacactatagcaaaatcacacagcagattggtttcagagctatgctggaaacagc

SEQ ID NO: 54307 - DNA, 70 bp, Artificial Sequence
  Synthetic
gccaagcatttaggtgacactatagaggaggagagccagctgtaggtttcagagctatgctggaaacagc

SEQ ID NO: 54308 - DNA, 70 bp, Artificial Sequence
  Synthetic
gccaagcatttaggtgacactatagagaggacatctgcggtcatagtttcagagctatgctggaaacagc

SEQ ID NO: 54309 - DNA, 70 bp, Artificial Sequence
  Synthetic
gccaagcatttaggtgacactatagtacagatctaatacagctgggtttcagagctatgctggaaacagc

SEQ ID NO: 54310 - DNA, 70 bp, Artificial Sequence
  Synthetic
gccaagcatttaggtgacactatagttcttgactcttagacgttcgtttcagagctatgctggaaacagc

SEQ ID NO: 54311 - DNA, 70 bp, Artificial Sequence
  Synthetic
gccaagcatttaggtgacactatagacgcgggtggccctctgaccgtttcagagctatgctggaaacagc

SEQ ID NO: 54312 - DNA, 70 bp, Artificial Sequence
  Synthetic
gccaagcatttaggtgacactataggataatgcttcactttctgcgtttcagagctatgctggaaacagc

SEQ ID NO: 54313 - DNA, 70 bp, Artificial Sequence
  Synthetic
gccaagcatttaggtgacactatagctgacgggacgacacatctggtttcagagctatgctggaaacagc

SEQ ID NO: 54314 - DNA, 70 bp, Artificial Sequence
  Synthetic
gccaagcatttaggtgacactatagaattgtctggtttatacgtcgtttcagagctatgctggaaacagc

SEQ ID NO: 54315 - DNA, 70 bp, Artificial Sequence
  Synthetic
gccaagcatttaggtgacactatagatcgccccggagcttatgaggtttcagagctatgctggaaacagc

SEQ ID NO: 54316 - DNA, 70 bp, Artificial Sequence
  Synthetic
gccaagcatttaggtgacactatagaagcctctctactttcttacgtttcagagctatgctggaaacagc

SEQ ID NO: 54317 - DNA, 70 bp, Artificial Sequence
  Synthetic
gccaagcatttaggtgacactatagtcgttgcatatccatcgattgtttcagagctatgctggaaacagc

SEQ ID NO: 54318 - DNA, 70 bp, Artificial Sequence
  Synthetic
gccaagcatttaggtgacactataggtccgtgaacctgagcgactgtttcagagctatgctggaaacagc

SEQ ID NO: 54319 - DNA, 70 bp, Artificial Sequence
  Synthetic
gccaagcatttaggtgacactatagtcaccctgacggagatctaagtttcagagctatgctggaaacagc

SEQ ID NO: 54320 - DNA, 70 bp, Artificial Sequence
  Synthetic
gccaagcatttaggtgacactataggggcttcaaggtcacgctcagtttcagagctatgctggaaacagc

SEQ ID NO: 54321 - DNA, 70 bp, Artificial Sequence
  Synthetic
gccaagcatttaggtgacactatagcctgcacttcactgtaaactgtttcagagctatgctggaaacagc

SEQ ID NO: 54322 - DNA, 70 bp, Artificial Sequence
  Synthetic
gccaagcatttaggtgacactatagatcatccttaaggagctgtagtttcagagctatgctggaaacagc

SEQ ID NO: 54323 - DNA, 70 bp, Artificial Sequence
  Synthetic
gccaagcatttaggtgacactatagggctacagcttgagttcactgtttcagagctatgctggaaacagc

SEQ ID NO: 54324 - DNA, 70 bp, Artificial Sequence
  Synthetic
gccaagcatttaggtgacactataggggagccacgggattgtaacgtttcagagctatgctggaaacagc

SEQ ID NO: 54325 - DNA, 70 bp, Artificial Sequence
  Synthetic
gccaagcatttaggtgacactatagaaggaaggttacaacgtatagtttcagagctatgctggaaacagc

SEQ ID NO: 54326 - DNA, 70 bp, Artificial Sequence
  Synthetic
gccaagcatttaggtgacactatagaactgggcctattgtatctggtttcagagctatgctggaaacagc

SEQ ID NO: 54327 - DNA, 70 bp, Artificial Sequence
  Synthetic
gccaagcatttaggtgacactatagacagagagtgttaagatctagtttcagagctatgctggaaacagc

SEQ ID NO: 54328 - DNA, 70 bp, Artificial Sequence
  Synthetic
gccaagcatttaggtgacactatagagagaaggttacaacgtatagtttcagagctatgctggaaacagc

SEQ ID NO: 54329 - DNA, 70 bp, Artificial Sequence
  Synthetic
gccaagcatttaggtgacactatagaggattggctgtcattgcatgtttcagagctatgctggaaacagc

SEQ ID NO: 54330 - DNA, 70 bp, Artificial Sequence
  Synthetic
gccaagcatttaggtgacactatagtgctattgagaacagaacaggtttcagagctatgctggaaacagc

SEQ ID NO: 54331 - DNA, 70 bp, Artificial Sequence
  Synthetic
gccaagcatttaggtgacactataggggcaggcggcgcagtcagagtttcagagctatgctggaaacagc

SEQ ID NO: 54332 - DNA, 70 bp, Artificial Sequence
  Synthetic
gccaagcatttaggtgacactatagtttgtttgatgctcatatgggtttcagagctatgctggaaacagc

SEQ ID NO: 54333 - DNA, 70 bp, Artificial Sequence
  Synthetic
gccaagcatttaggtgacactataggcggtgtggccactgtcaccgtttcagagctatgctggaaacagc

SEQ ID NO: 54334 - DNA, 70 bp, Artificial Sequence
  Synthetic
gccaagcatttaggtgacactatagccaagaggggcctgagctgggtttcagagctatgctggaaacagc

SEQ ID NO: 54335 - DNA, 70 bp, Artificial Sequence
  Synthetic
gccaagcatttaggtgacactatagaactcagagaaaagagactggtttcagagctatgctggaaacagc

SEQ ID NO: 54336 - DNA, 70 bp, Artificial Sequence
  Synthetic
gccaagcatttaggtgacactatagcaaagaggaaggaactgaaagtttcagagctatgctggaaacagc

SEQ ID NO: 54337 - DNA, 70 bp, Artificial Sequence
  Synthetic
gccaagcatttaggtgacactatagtgattacacagtatgaactggtttcagagctatgctggaaacagc

SEQ ID NO: 54338 - DNA, 70 bp, Artificial Sequence
  Synthetic
gccaagcatttaggtgacactatagattactaaacagtgtctggagtttcagagctatgctggaaacagc

SEQ ID NO: 54339 - DNA, 70 bp, Artificial Sequence
  Synthetic
gccaagcatttaggtgacactatagggcctcccagctttatgccagtttcagagctatgctggaaacagc

SEQ ID NO: 54340 - DNA, 70 bp, Artificial Sequence
  Synthetic
gccaagcatttaggtgacactatagtgatgacaacactgtagaaagtttcagagctatgctggaaacagc

SEQ ID NO: 54341 - DNA, 70 bp, Artificial Sequence
  Synthetic
gccaagcatttaggtgacactatagcccaccccagctgtgcctaggtttcagagctatgctggaaacagc

SEQ ID NO: 54342 - DNA, 70 bp, Artificial Sequence
  Synthetic
gccaagcatttaggtgacactatagctgtggcctccgggactactgtttcagagctatgctggaaacagc

SEQ ID NO: 54343 - DNA, 70 bp, Artificial Sequence
  Synthetic
gccaagcatttaggtgacactatagctggacaaagctacccaaaggtttcagagctatgctggaaacagc

SEQ ID NO: 54344 - DNA, 70 bp, Artificial Sequence
  Synthetic
gccaagcatttaggtgacactataggagaccgggaatttcagacagtttcagagctatgctggaaacagc

SEQ ID NO: 54345 - DNA, 70 bp, Artificial Sequence
  Synthetic
gccaagcatttaggtgacactatagcgccggcccccgggagctgggtttcagagctatgctggaaacagc

SEQ ID NO: 54346 - DNA, 70 bp, Artificial Sequence
  Synthetic
gccaagcatttaggtgacactatagagtctcagctctccctatgagtttcagagctatgctggaaacagc

SEQ ID NO: 54347 - DNA, 70 bp, Artificial Sequence
  Synthetic
gccaagcatttaggtgacactatagtcggtcagcaccgtggtgtggtttcagagctatgctggaaacagc

SEQ ID NO: 54348 - DNA, 70 bp, Artificial Sequence
  Synthetic
gccaagcatttaggtgacactataggatagctgtcattcaccgccgtttcagagctatgctggaaacagc

SEQ ID NO: 54349 - DNA, 70 bp, Artificial Sequence
  Synthetic
gccaagcatttaggtgacactataggtacacgcgtctattgctgcgtttcagagctatgctggaaacagc

SEQ ID NO: 54350 - DNA, 70 bp, Artificial Sequence
  Synthetic
gccaagcatttaggtgacactatagctcataaacatgcccattgcgtttcagagctatgctggaaacagc

SEQ ID NO: 54351 - DNA, 70 bp, Artificial Sequence
  Synthetic
gccaagcatttaggtgacactatagcacacaggccaaagttttaagtttcagagctatgctggaaacagc

SEQ ID NO: 54352 - DNA, 70 bp, Artificial Sequence
  Synthetic
gccaagcatttaggtgacactatagtcacacttctgactccagacgtttcagagctatgctggaaacagc

SEQ ID NO: 54353 - DNA, 70 bp, Artificial Sequence
  Synthetic
gccaagcatttaggtgacactatagctcgagtccgaggtatgacggtttcagagctatgctggaaacagc

SEQ ID NO: 54354 - DNA, 70 bp, Artificial Sequence
  Synthetic
gccaagcatttaggtgacactatagaagtcggacttgtgagtcctgtttcagagctatgctggaaacagc

SEQ ID NO: 54355 - DNA, 70 bp, Artificial Sequence
  Synthetic
gccaagcatttaggtgacactatagccggggagccaggaatgagggtttcagagctatgctggaaacagc

SEQ ID NO: 54356 - DNA, 70 bp, Artificial Sequence
  Synthetic
gccaagcatttaggtgacactataggctggagctcggctactcctgtttcagagctatgctggaaacagc

SEQ ID NO: 54357 - DNA, 70 bp, Artificial Sequence
  Synthetic
gccaagcatttaggtgacactataggcctagccacggtggtaattgtttcagagctatgctggaaacagc

SEQ ID NO: 54358 - DNA, 70 bp, Artificial Sequence
  Synthetic
gccaagcatttaggtgacactatagcatgctgacttcagagcatcgtttcagagctatgctggaaacagc

SEQ ID NO: 54359 - DNA, 70 bp, Artificial Sequence
  Synthetic
gccaagcatttaggtgacactataggcagcctgcaggtctttagcgtttcagagctatgctggaaacagc

SEQ ID NO: 54360 - DNA, 70 bp, Artificial Sequence
  Synthetic
gccaagcatttaggtgacactatagagggatgtgtctggtttcctgtttcagagctatgctggaaacagc

SEQ ID NO: 54361 - DNA, 70 bp, Artificial Sequence
  Synthetic
gccaagcatttaggtgacactatagaaggcgggtgggcgggtcaggtttcagagctatgctggaaacagc

SEQ ID NO: 54362 - DNA, 70 bp, Artificial Sequence
  Synthetic
gccaagcatttaggtgacactatagtccctgtttctgggtgctaggtttcagagctatgctggaaacagc

SEQ ID NO: 54363 - DNA, 70 bp, Artificial Sequence
  Synthetic
gccaagcatttaggtgacactatagccggggtgctcagcattgctgtttcagagctatgctggaaacagc

SEQ ID NO: 54364 - DNA, 70 bp, Artificial Sequence
  Synthetic
gccaagcatttaggtgacactataggagccgaaactagctgcttcgtttcagagctatgctggaaacagc

SEQ ID NO: 54365 - DNA, 70 bp, Artificial Sequence
  Synthetic
gccaagcatttaggtgacactatagagagactcttcagtcgccaagtttcagagctatgctggaaacagc

SEQ ID NO: 54366 - DNA, 70 bp, Artificial Sequence
  Synthetic
gccaagcatttaggtgacactatagaggcccccaccagcagttgggtttcagagctatgctggaaacagc

SEQ ID NO: 54367 - DNA, 70 bp, Artificial Sequence
  Synthetic
gccaagcatttaggtgacactatagggcctcgggctgggggctaggtttcagagctatgctggaaacagc

SEQ ID NO: 54368 - DNA, 70 bp, Artificial Sequence
  Synthetic
gccaagcatttaggtgacactatagtaacaaacacacgccagactgtttcagagctatgctggaaacagc

SEQ ID NO: 54369 - DNA, 70 bp, Artificial Sequence
  Synthetic
gccaagcatttaggtgacactatagagctcttccaccctgtaagggtttcagagctatgctggaaacagc

SEQ ID NO: 54370 - DNA, 70 bp, Artificial Sequence
  Synthetic
gccaagcatttaggtgacactatagcaaagctgcacatgtgccgagtttcagagctatgctggaaacagc

SEQ ID NO: 54371 - DNA, 70 bp, Artificial Sequence
  Synthetic
gccaagcatttaggtgacactataggcacgtgaagaccaatgagagtttcagagctatgctggaaacagc

SEQ ID NO: 54372 - DNA, 70 bp, Artificial Sequence
  Synthetic
gccaagcatttaggtgacactatagttgcaatggccgtgaggtgggtttcagagctatgctggaaacagc

SEQ ID NO: 54373 - DNA, 70 bp, Artificial Sequence
  Synthetic
gccaagcatttaggtgacactatagaattcacaatcacagagatggtttcagagctatgctggaaacagc

SEQ ID NO: 54374 - DNA, 70 bp, Artificial Sequence
  Synthetic
gccaagcatttaggtgacactatagcatggactcgctagattgcagtttcagagctatgctggaaacagc

SEQ ID NO: 54375 - DNA, 70 bp, Artificial Sequence
  Synthetic
gccaagcatttaggtgacactatagcagggacattcacaacgacggtttcagagctatgctggaaacagc

SEQ ID NO: 54376 - DNA, 70 bp, Artificial Sequence
  Synthetic
gccaagcatttaggtgacactataggcagaggcccacaagtagcagtttcagagctatgctggaaacagc

SEQ ID NO: 54377 - DNA, 70 bp, Artificial Sequence
  Synthetic
gccaagcatttaggtgacactatagatggaacaggttagataaccgtttcagagctatgctggaaacagc

SEQ ID NO: 54378 - DNA, 70 bp, Artificial Sequence
  Synthetic
gccaagcatttaggtgacactataggcagtcaaaagctatactgtgtttcagagctatgctggaaacagc

SEQ ID NO: 54379 - DNA, 70 bp, Artificial Sequence
  Synthetic
gccaagcatttaggtgacactatagaaatgacagaccaaatggcggtttcagagctatgctggaaacagc

SEQ ID NO: 54380 - DNA, 70 bp, Artificial Sequence
  Synthetic
gccaagcatttaggtgacactatagagtttccgatggtcaagagcgtttcagagctatgctggaaacagc

SEQ ID NO: 54381 - DNA, 70 bp, Artificial Sequence
  Synthetic
gccaagcatttaggtgacactatagccttgagacagctgctgtgagtttcagagctatgctggaaacagc

SEQ ID NO: 54382 - DNA, 70 bp, Artificial Sequence
  Synthetic
gccaagcatttaggtgacactatagattatcattgctggttcagcgtttcagagctatgctggaaacagc

SEQ ID NO: 54383 - DNA, 70 bp, Artificial Sequence
  Synthetic
gccaagcatttaggtgacactataggaggccatcattatcattgcgtttcagagctatgctggaaacagc

SEQ ID NO: 54384 - DNA, 70 bp, Artificial Sequence
  Synthetic
gccaagcatttaggtgacactatagcgccctggtgggggtggtgagtttcagagctatgctggaaacagc

SEQ ID NO: 54385 - DNA, 70 bp, Artificial Sequence
  Synthetic
gccaagcatttaggtgacactatagtctcagagaagactgtgaaggtttcagagctatgctggaaacagc

SEQ ID NO: 54386 - DNA, 70 bp, Artificial Sequence
  Synthetic
gccaagcatttaggtgacactatagatggaaacatctgtcacgaggtttcagagctatgctggaaacagc

SEQ ID NO: 54387 - DNA, 70 bp, Artificial Sequence
  Synthetic
gccaagcatttaggtgacactatagttcctgaattcatgtccaaagtttcagagctatgctggaaacagc

SEQ ID NO: 54388 - DNA, 70 bp, Artificial Sequence
  Synthetic
gccaagcatttaggtgacactatagagttggtccagtgtcaactcgtttcagagctatgctggaaacagc

SEQ ID NO: 54389 - DNA, 70 bp, Artificial Sequence
  Synthetic
gccaagcatttaggtgacactataggacgggcaccagtgggcatagtttcagagctatgctggaaacagc

SEQ ID NO: 54390 - DNA, 70 bp, Artificial Sequence
  Synthetic
gccaagcatttaggtgacactataggggcccggctgctggcacaggtttcagagctatgctggaaacagc

SEQ ID NO: 54391 - DNA, 70 bp, Artificial Sequence
  Synthetic
gccaagcatttaggtgacactatagttccgcaccatcagcgtctggtttcagagctatgctggaaacagc

SEQ ID NO: 54392 - DNA, 70 bp, Artificial Sequence
  Synthetic
gccaagcatttaggtgacactatagtaagaactgtgctggttaatgtttcagagctatgctggaaacagc

SEQ ID NO: 54393 - DNA, 70 bp, Artificial Sequence
  Synthetic
gccaagcatttaggtgacactatagtattgattgcaaatctggcagtttcagagctatgctggaaacagc

SEQ ID NO: 54394 - DNA, 70 bp, Artificial Sequence
  Synthetic
gccaagcatttaggtgacactatagtgtggatgcagaatttgtaggtttcagagctatgctggaaacagc

SEQ ID NO: 54395 - DNA, 70 bp, Artificial Sequence
  Synthetic
gccaagcatttaggtgacactatagaaacacaccgcgatgcttttgtttcagagctatgctggaaacagc

SEQ ID NO: 54396 - DNA, 70 bp, Artificial Sequence
  Synthetic
gccaagcatttaggtgacactatagatttggactcggacagctgagtttcagagctatgctggaaacagc

SEQ ID NO: 54397 - DNA, 70 bp, Artificial Sequence
  Synthetic
gccaagcatttaggtgacactataggcgtcaagaagtccccgaaggtttcagagctatgctggaaacagc

SEQ ID NO: 54398 - DNA, 70 bp, Artificial Sequence
  Synthetic
gccaagcatttaggtgacactataggacgtaaaaggcaaattagggtttcagagctatgctggaaacagc

SEQ ID NO: 54399 - DNA, 70 bp, Artificial Sequence
  Synthetic
gccaagcatttaggtgacactatagttgtagttaggaagagacaggtttcagagctatgctggaaacagc

SEQ ID NO: 54400 - DNA, 70 bp, Artificial Sequence
  Synthetic
gccaagcatttaggtgacactataggttgctgcagcagctggctggtttcagagctatgctggaaacagc

SEQ ID NO: 54401 - DNA, 70 bp, Artificial Sequence
  Synthetic
gccaagcatttaggtgacactatagcatgcccgggcacaggctaggtttcagagctatgctggaaacagc

SEQ ID NO: 54402 - DNA, 70 bp, Artificial Sequence
  Synthetic
gccaagcatttaggtgacactataggtgcaagggaaaccgtcaccgtttcagagctatgctggaaacagc

SEQ ID NO: 54403 - DNA, 70 bp, Artificial Sequence
  Synthetic
gccaagcatttaggtgacactatagcacgtacaccaggatggtgcgtttcagagctatgctggaaacagc

SEQ ID NO: 54404 - DNA, 70 bp, Artificial Sequence
  Synthetic
gccaagcatttaggtgacactatagtgtagaggaagagcagtgttgtttcagagctatgctggaaacagc

SEQ ID NO: 54405 - DNA, 70 bp, Artificial Sequence
  Synthetic
gccaagcatttaggtgacactataggtgctgggtcttggggcactgtttcagagctatgctggaaacagc

SEQ ID NO: 54406 - DNA, 70 bp, Artificial Sequence
  Synthetic
gccaagcatttaggtgacactatagtgaatagatggatgcacagcgtttcagagctatgctggaaacagc

SEQ ID NO: 54407 - DNA, 70 bp, Artificial Sequence
  Synthetic
gccaagcatttaggtgacactatagtagcatatggacaccttgccgtttcagagctatgctggaaacagc

SEQ ID NO: 54408 - DNA, 70 bp, Artificial Sequence
  Synthetic
gccaagcatttaggtgacactatagtgcttggtggggccctcagggtttcagagctatgctggaaacagc

SEQ ID NO: 54409 - DNA, 70 bp, Artificial Sequence
  Synthetic
gccaagcatttaggtgacactataggctgctcgggactgttcagggtttcagagctatgctggaaacagc

SEQ ID NO: 54410 - DNA, 70 bp, Artificial Sequence
  Synthetic
gccaagcatttaggtgacactatagctggaagctttgaaaagagagtttcagagctatgctggaaacagc

SEQ ID NO: 54411 - DNA, 70 bp, Artificial Sequence
  Synthetic
gccaagcatttaggtgacactataggctgagctggctgcctgagggtttcagagctatgctggaaacagc

SEQ ID NO: 54412 - DNA, 70 bp, Artificial Sequence
  Synthetic
gccaagcatttaggtgacactataggagggtaagaccattgcaatgtttcagagctatgctggaaacagc

SEQ ID NO: 54413 - DNA, 70 bp, Artificial Sequence
  Synthetic
gccaagcatttaggtgacactatagaaaattgcttagtccttctcgtttcagagctatgctggaaacagc

SEQ ID NO: 54414 - DNA, 70 bp, Artificial Sequence
  Synthetic
gccaagcatttaggtgacactatagccctacctcttcagaagagcgtttcagagctatgctggaaacagc

SEQ ID NO: 54415 - DNA, 70 bp, Artificial Sequence
  Synthetic
gccaagcatttaggtgacactatagacaacccataccctgtgtgagtttcagagctatgctggaaacagc

SEQ ID NO: 54416 - DNA, 70 bp, Artificial Sequence
  Synthetic
gccaagcatttaggtgacactatagaagaagcaaggaagattttcgtttcagagctatgctggaaacagc

SEQ ID NO: 54417 - DNA, 70 bp, Artificial Sequence
  Synthetic
gccaagcatttaggtgacactatagaaagatttctcatccatggggtttcagagctatgctggaaacagc

SEQ ID NO: 54418 - DNA, 70 bp, Artificial Sequence
  Synthetic
gccaagcatttaggtgacactatagaagaagccagaaagattttcgtttcagagctatgctggaaacagc

SEQ ID NO: 54419 - DNA, 70 bp, Artificial Sequence
  Synthetic
gccaagcatttaggtgacactataggaaccgtctacaacatctttgtttcagagctatgctggaaacagc

SEQ ID NO: 54420 - DNA, 70 bp, Artificial Sequence
  Synthetic
gccaagcatttaggtgacactatagtttttgggagagcagctctcgtttcagagctatgctggaaacagc

SEQ ID NO: 54421 - DNA, 70 bp, Artificial Sequence
  Synthetic
gccaagcatttaggtgacactatagctccgggcaatcttaaagtcgtttcagagctatgctggaaacagc

SEQ ID NO: 54422 - DNA, 70 bp, Artificial Sequence
  Synthetic
gccaagcatttaggtgacactataggctgtctggggcaacaagtagtttcagagctatgctggaaacagc

SEQ ID NO: 54423 - DNA, 70 bp, Artificial Sequence
  Synthetic
gccaagcatttaggtgacactatagatcgggagatgaagtccttcgtttcagagctatgctggaaacagc

SEQ ID NO: 54424 - DNA, 70 bp, Artificial Sequence
  Synthetic
gccaagcatttaggtgacactatagaacaagcctgtatgctgagcgtttcagagctatgctggaaacagc

SEQ ID NO: 54425 - DNA, 70 bp, Artificial Sequence
  Synthetic
gccaagcatttaggtgacactatagtacacaagggtggctgtctggtttcagagctatgctggaaacagc

SEQ ID NO: 54426 - DNA, 70 bp, Artificial Sequence
  Synthetic
gccaagcatttaggtgacactatagtttcctgtggcataatgtgagtttcagagctatgctggaaacagc

SEQ ID NO: 54427 - DNA, 70 bp, Artificial Sequence
  Synthetic
gccaagcatttaggtgacactataggctacatggaacagcaaatagtttcagagctatgctggaaacagc

SEQ ID NO: 54428 - DNA, 70 bp, Artificial Sequence
  Synthetic
gccaagcatttaggtgacactatagtgtgactatgggctctgaaggtttcagagctatgctggaaacagc

SEQ ID NO: 54429 - DNA, 70 bp, Artificial Sequence
  Synthetic
gccaagcatttaggtgacactatagaccctaatgcctttgactttgtttcagagctatgctggaaacagc

SEQ ID NO: 54430 - DNA, 70 bp, Artificial Sequence
  Synthetic
gccaagcatttaggtgacactatagatggcaacgggaaacagtgagtttcagagctatgctggaaacagc

SEQ ID NO: 54431 - DNA, 70 bp, Artificial Sequence
  Synthetic
gccaagcatttaggtgacactatagccccatcccagacccttcaggtttcagagctatgctggaaacagc

SEQ ID NO: 54432 - DNA, 70 bp, Artificial Sequence
  Synthetic
gccaagcatttaggtgacactatagagatacacccactgagctgagtttcagagctatgctggaaacagc

SEQ ID NO: 54433 - DNA, 70 bp, Artificial Sequence
  Synthetic
gccaagcatttaggtgacactatagggatcttacggtcactccctgtttcagagctatgctggaaacagc

SEQ ID NO: 54434 - DNA, 70 bp, Artificial Sequence
  Synthetic
gccaagcatttaggtgacactatagggaggaggccctccctcatagtttcagagctatgctggaaacagc

SEQ ID NO: 54435 - DNA, 70 bp, Artificial Sequence
  Synthetic
gccaagcatttaggtgacactatagacattgtctggcctcacagggtttcagagctatgctggaaacagc

SEQ ID NO: 54436 - DNA, 70 bp, Artificial Sequence
  Synthetic
gccaagcatttaggtgacactatagatctgtcacaaatcttccctgtttcagagctatgctggaaacagc

SEQ ID NO: 54437 - DNA, 70 bp, Artificial Sequence
  Synthetic
gccaagcatttaggtgacactatagctggtctcttgcagaaattcgtttcagagctatgctggaaacagc

SEQ ID NO: 54438 - DNA, 70 bp, Artificial Sequence
  Synthetic
gccaagcatttaggtgacactatagaagccattggagatgcagaagtttcagagctatgctggaaacagc

SEQ ID NO: 54439 - DNA, 70 bp, Artificial Sequence
  Synthetic
gccaagcatttaggtgacactataggtgaaaattgtagcctgtgagtttcagagctatgctggaaacagc

SEQ ID NO: 54440 - DNA, 70 bp, Artificial Sequence
  Synthetic
gccaagcatttaggtgacactataggctgcctcaatttatagctggtttcagagctatgctggaaacagc

SEQ ID NO: 54441 - DNA, 70 bp, Artificial Sequence
  Synthetic
gccaagcatttaggtgacactatagtagggaaagctcactcaaaggtttcagagctatgctggaaacagc

SEQ ID NO: 54442 - DNA, 70 bp, Artificial Sequence
  Synthetic
gccaagcatttaggtgacactatagtgacattacttccagcaaatgtttcagagctatgctggaaacagc

SEQ ID NO: 54443 - DNA, 70 bp, Artificial Sequence
  Synthetic
gccaagcatttaggtgacactatagtgtcagttttctgtggatgagtttcagagctatgctggaaacagc

SEQ ID NO: 54444 - DNA, 70 bp, Artificial Sequence
  Synthetic
gccaagcatttaggtgacactatagcacttctccctcaaggagtggtttcagagctatgctggaaacagc

SEQ ID NO: 54445 - DNA, 70 bp, Artificial Sequence
  Synthetic
gccaagcatttaggtgacactatagccagagtacagacactatcagtttcagagctatgctggaaacagc

SEQ ID NO: 54446 - DNA, 70 bp, Artificial Sequence
  Synthetic
gccaagcatttaggtgacactatagctgatgaagaaaacgtgagggtttcagagctatgctggaaacagc

SEQ ID NO: 54447 - DNA, 70 bp, Artificial Sequence
  Synthetic
gccaagcatttaggtgacactatagtgctggaatcaaacacctgagtttcagagctatgctggaaacagc

SEQ ID NO: 54448 - DNA, 70 bp, Artificial Sequence
  Synthetic
gccaagcatttaggtgacactatagaaactgaaagtgtctgcctggtttcagagctatgctggaaacagc

SEQ ID NO: 54449 - DNA, 70 bp, Artificial Sequence
  Synthetic
gccaagcatttaggtgacactatagacgtcaagcgcttttggaaggtttcagagctatgctggaaacagc

SEQ ID NO: 54450 - DNA, 70 bp, Artificial Sequence
  Synthetic
gccaagcatttaggtgacactataggcattcctctcataaagcaagtttcagagctatgctggaaacagc

SEQ ID NO: 54451 - DNA, 70 bp, Artificial Sequence
  Synthetic
gccaagcatttaggtgacactatagggaagtaccagcagaaggttgtttcagagctatgctggaaacagc

SEQ ID NO: 54452 - DNA, 70 bp, Artificial Sequence
  Synthetic
gccaagcatttaggtgacactataggagggaagaggtctaccacggtttcagagctatgctggaaacagc

SEQ ID NO: 54453 - DNA, 70 bp, Artificial Sequence
  Synthetic
gccaagcatttaggtgacactatagactgaggtctagtaattaaggtttcagagctatgctggaaacagc

SEQ ID NO: 54454 - DNA, 70 bp, Artificial Sequence
  Synthetic
gccaagcatttaggtgacactatagcccaatctcaaaaggatcgcgtttcagagctatgctggaaacagc

SEQ ID NO: 54455 - DNA, 70 bp, Artificial Sequence
  Synthetic
gccaagcatttaggtgacactatagtactccacatcgcaacgtgagtttcagagctatgctggaaacagc

SEQ ID NO: 54456 - DNA, 70 bp, Artificial Sequence
  Synthetic
gccaagcatttaggtgacactatagagcagtgcagttcttagccagtttcagagctatgctggaaacagc

SEQ ID NO: 54457 - DNA, 70 bp, Artificial Sequence
  Synthetic
gccaagcatttaggtgacactataggacgcccacaggggtcctaggtttcagagctatgctggaaacagc

SEQ ID NO: 54458 - DNA, 70 bp, Artificial Sequence
  Synthetic
gccaagcatttaggtgacactatagtgtgggccaaggctagggaggtttcagagctatgctggaaacagc

SEQ ID NO: 54459 - DNA, 70 bp, Artificial Sequence
  Synthetic
gccaagcatttaggtgacactatagagatatcacagtgaagttgagtttcagagctatgctggaaacagc

SEQ ID NO: 54460 - DNA, 70 bp, Artificial Sequence
  Synthetic
gccaagcatttaggtgacactatagcaaaagcgtttgagccattcgtttcagagctatgctggaaacagc

SEQ ID NO: 54461 - DNA, 70 bp, Artificial Sequence
  Synthetic
gccaagcatttaggtgacactatagaagacaggagaatcacagaagtttcagagctatgctggaaacagc

SEQ ID NO: 54462 - DNA, 70 bp, Artificial Sequence
  Synthetic
gccaagcatttaggtgacactatagattctggactacgtgtgacagtttcagagctatgctggaaacagc

SEQ ID NO: 54463 - DNA, 70 bp, Artificial Sequence
  Synthetic
gccaagcatttaggtgacactataggatataccttctgagacagagtttcagagctatgctggaaacagc

SEQ ID NO: 54464 - DNA, 70 bp, Artificial Sequence
  Synthetic
gccaagcatttaggtgacactatagggggaaggttcagcagccgcgtttcagagctatgctggaaacagc

SEQ ID NO: 54465 - DNA, 70 bp, Artificial Sequence
  Synthetic
gccaagcatttaggtgacactatagtgctgttactacttccaaaagtttcagagctatgctggaaacagc

SEQ ID NO: 54466 - DNA, 70 bp, Artificial Sequence
  Synthetic
gccaagcatttaggtgacactatagaagggttcagaagcccatgtgtttcagagctatgctggaaacagc

SEQ ID NO: 54467 - DNA, 70 bp, Artificial Sequence
  Synthetic
gccaagcatttaggtgacactatagcttctgtgtgggcaagtgacgtttcagagctatgctggaaacagc

SEQ ID NO: 54468 - DNA, 70 bp, Artificial Sequence
  Synthetic
gccaagcatttaggtgacactatagggaaagctggtaaaaaggacgtttcagagctatgctggaaacagc

SEQ ID NO: 54469 - DNA, 70 bp, Artificial Sequence
  Synthetic
gccaagcatttaggtgacactataggaagctctttccaggatgaagtttcagagctatgctggaaacagc

SEQ ID NO: 54470 - DNA, 70 bp, Artificial Sequence
  Synthetic
gccaagcatttaggtgacactatagtaacaggaagtcttgactaagtttcagagctatgctggaaacagc

SEQ ID NO: 54471 - DNA, 70 bp, Artificial Sequence
  Synthetic
gccaagcatttaggtgacactatagagacatcactaccatctctagtttcagagctatgctggaaacagc

SEQ ID NO: 54472 - DNA, 70 bp, Artificial Sequence
  Synthetic
gccaagcatttaggtgacactatagttggttcggcttagaacttggtttcagagctatgctggaaacagc

SEQ ID NO: 54473 - DNA, 70 bp, Artificial Sequence
  Synthetic
gccaagcatttaggtgacactatagctctgccgtatgttctgccagtttcagagctatgctggaaacagc

SEQ ID NO: 54474 - DNA, 70 bp, Artificial Sequence
  Synthetic
gccaagcatttaggtgacactatagcagctggcagtttactgtccgtttcagagctatgctggaaacagc

SEQ ID NO: 54475 - DNA, 70 bp, Artificial Sequence
  Synthetic
gccaagcatttaggtgacactatagagccgggcggtgcactcagcgtttcagagctatgctggaaacagc

SEQ ID NO: 54476 - DNA, 70 bp, Artificial Sequence
  Synthetic
gccaagcatttaggtgacactatagcggaaaagtgccatgttctggtttcagagctatgctggaaacagc

SEQ ID NO: 54477 - DNA, 70 bp, Artificial Sequence
  Synthetic
gccaagcatttaggtgacactatagtgacaaggctggtctagggagtttcagagctatgctggaaacagc

SEQ ID NO: 54478 - DNA, 70 bp, Artificial Sequence
  Synthetic
gccaagcatttaggtgacactataggcctgtaccggatgctaggggtttcagagctatgctggaaacagc

SEQ ID NO: 54479 - DNA, 70 bp, Artificial Sequence
  Synthetic
gccaagcatttaggtgacactatagggtacccagggctatctcaggtttcagagctatgctggaaacagc

SEQ ID NO: 54480 - DNA, 70 bp, Artificial Sequence
  Synthetic
gccaagcatttaggtgacactatagggacatcctctttgtctactgtttcagagctatgctggaaacagc

SEQ ID NO: 54481 - DNA, 70 bp, Artificial Sequence
  Synthetic
gccaagcatttaggtgacactatagtctctccaggctcagtcctggtttcagagctatgctggaaacagc

SEQ ID NO: 54482 - DNA, 70 bp, Artificial Sequence
  Synthetic
gccaagcatttaggtgacactatagtgatctgtagcaggtctcaggtttcagagctatgctggaaacagc

SEQ ID NO: 54483 - DNA, 70 bp, Artificial Sequence
  Synthetic
gccaagcatttaggtgacactatagatgcttccaaaagaaagatggtttcagagctatgctggaaacagc

SEQ ID NO: 54484 - DNA, 70 bp, Artificial Sequence
  Synthetic
gccaagcatttaggtgacactatagatgtcagcccaacaacttacgtttcagagctatgctggaaacagc

SEQ ID NO: 54485 - DNA, 70 bp, Artificial Sequence
  Synthetic
gccaagcatttaggtgacactatagtggttcttttttgcccttcagtttcagagctatgctggaaacagc

SEQ ID NO: 54486 - DNA, 70 bp, Artificial Sequence
  Synthetic
gccaagcatttaggtgacactataggcagctgaataccacagacagtttcagagctatgctggaaacagc

SEQ ID NO: 54487 - DNA, 70 bp, Artificial Sequence
  Synthetic
gccaagcatttaggtgacactataggcctcacttctcaagagaacgtttcagagctatgctggaaacagc

SEQ ID NO: 54488 - DNA, 70 bp, Artificial Sequence
  Synthetic
gccaagcatttaggtgacactatagttggtgagaaacaagccatagtttcagagctatgctggaaacagc

SEQ ID NO: 54489 - DNA, 70 bp, Artificial Sequence
  Synthetic
gccaagcatttaggtgacactatagcagaagggaaaaaaaagctggtttcagagctatgctggaaacagc

SEQ ID NO: 54490 - DNA, 70 bp, Artificial Sequence
  Synthetic
gccaagcatttaggtgacactataggctcaaaggaccggcgcctggtttcagagctatgctggaaacagc

SEQ ID NO: 54491 - DNA, 70 bp, Artificial Sequence
  Synthetic
gccaagcatttaggtgacactataggctgggtcgggggtcaccccgtttcagagctatgctggaaacagc

SEQ ID NO: 54492 - DNA, 70 bp, Artificial Sequence
  Synthetic
gccaagcatttaggtgacactatagccttttgacccatttaactggtttcagagctatgctggaaacagc

SEQ ID NO: 54493 - DNA, 70 bp, Artificial Sequence
  Synthetic
gccaagcatttaggtgacactataggtctcgacccgttagacagtgtttcagagctatgctggaaacagc

SEQ ID NO: 54494 - DNA, 70 bp, Artificial Sequence
  Synthetic
gccaagcatttaggtgacactatagtcagtcttgctcaagtaaacgtttcagagctatgctggaaacagc

SEQ ID NO: 54495 - DNA, 70 bp, Artificial Sequence
  Synthetic
gccaagcatttaggtgacactatagcacatcttccttatcaccacgtttcagagctatgctggaaacagc

SEQ ID NO: 54496 - DNA, 70 bp, Artificial Sequence
  Synthetic
gccaagcatttaggtgacactatagaccaagaatcacttttccttgtttcagagctatgctggaaacagc

SEQ ID NO: 54497 - DNA, 70 bp, Artificial Sequence
  Synthetic
gccaagcatttaggtgacactatagaaatattcagtgcatctggtgtttcagagctatgctggaaacagc

SEQ ID NO: 54498 - DNA, 70 bp, Artificial Sequence
  Synthetic
gccaagcatttaggtgacactatagcagaaacaaggcttgtgaaggtttcagagctatgctggaaacagc

SEQ ID NO: 54499 - DNA, 70 bp, Artificial Sequence
  Synthetic
gccaagcatttaggtgacactatagaaatgcagtgtttctactgggtttcagagctatgctggaaacagc

SEQ ID NO: 54500 - DNA, 70 bp, Artificial Sequence
  Synthetic
gccaagcatttaggtgacactataggaccggttcctgcagtaatcgtttcagagctatgctggaaacagc

SEQ ID NO: 54501 - DNA, 70 bp, Artificial Sequence
  Synthetic
gccaagcatttaggtgacactatagcttaaaggcacgtctgtgtcgtttcagagctatgctggaaacagc

SEQ ID NO: 54502 - DNA, 70 bp, Artificial Sequence
  Synthetic
gccaagcatttaggtgacactatagtgtgtgatggctggtattatgtttcagagctatgctggaaacagc

SEQ ID NO: 54503 - DNA, 70 bp, Artificial Sequence
  Synthetic
gccaagcatttaggtgacactataggacctccacccccaccataagtttcagagctatgctggaaacagc

SEQ ID NO: 54504 - DNA, 70 bp, Artificial Sequence
  Synthetic
gccaagcatttaggtgacactatagttcctcctcccagaacacctgtttcagagctatgctggaaacagc

SEQ ID NO: 54505 - DNA, 70 bp, Artificial Sequence
  Synthetic
gccaagcatttaggtgacactataggaggtgatgcttgttgttgtgtttcagagctatgctggaaacagc

SEQ ID NO: 54506 - DNA, 70 bp, Artificial Sequence
  Synthetic
gccaagcatttaggtgacactatagcttagttacgctcctcgcccgtttcagagctatgctggaaacagc

SEQ ID NO: 54507 - DNA, 70 bp, Artificial Sequence
  Synthetic
gccaagcatttaggtgacactatagcatgggaagaaaaagctgcagtttcagagctatgctggaaacagc

SEQ ID NO: 54508 - DNA, 70 bp, Artificial Sequence
  Synthetic
gccaagcatttaggtgacactatagcagctcgctaagctcactgagtttcagagctatgctggaaacagc

SEQ ID NO: 54509 - DNA, 70 bp, Artificial Sequence
  Synthetic
gccaagcatttaggtgacactataggcttcactctttgagcaacagtttcagagctatgctggaaacagc

SEQ ID NO: 54510 - DNA, 70 bp, Artificial Sequence
  Synthetic
gccaagcatttaggtgacactatagtctcaaagaaacacctcaacgtttcagagctatgctggaaacagc

SEQ ID NO: 54511 - DNA, 70 bp, Artificial Sequence
  Synthetic
gccaagcatttaggtgacactatagctgtagttagtagcgtttcagtttcagagctatgctggaaacagc

SEQ ID NO: 54512 - DNA, 70 bp, Artificial Sequence
  Synthetic
gccaagcatttaggtgacactatagagtctcatgcctgctgttaggtttcagagctatgctggaaacagc

SEQ ID NO: 54513 - DNA, 70 bp, Artificial Sequence
  Synthetic
gccaagcatttaggtgacactatagaatttgtatgaggcgggacagtttcagagctatgctggaaacagc

SEQ ID NO: 54514 - DNA, 70 bp, Artificial Sequence
  Synthetic
gccaagcatttaggtgacactatagccccagggcatcaggccgatgtttcagagctatgctggaaacagc

SEQ ID NO: 54515 - DNA, 70 bp, Artificial Sequence
  Synthetic
gccaagcatttaggtgacactataggcctcccaggagtactaagagtttcagagctatgctggaaacagc

SEQ ID NO: 54516 - DNA, 70 bp, Artificial Sequence
  Synthetic
gccaagcatttaggtgacactataggacaacagaagactgtctaagtttcagagctatgctggaaacagc

SEQ ID NO: 54517 - DNA, 70 bp, Artificial Sequence
  Synthetic
gccaagcatttaggtgacactatagacgacgccttcctgggatgagtttcagagctatgctggaaacagc

SEQ ID NO: 54518 - DNA, 70 bp, Artificial Sequence
  Synthetic
gccaagcatttaggtgacactatagcatggcaagagggtcaccccgtttcagagctatgctggaaacagc

SEQ ID NO: 54519 - DNA, 70 bp, Artificial Sequence
  Synthetic
gccaagcatttaggtgacactatagaaaagtgaaagtggcttctagtttcagagctatgctggaaacagc

SEQ ID NO: 54520 - DNA, 70 bp, Artificial Sequence
  Synthetic
gccaagcatttaggtgacactataggggctctttcaagacagcgcgtttcagagctatgctggaaacagc

SEQ ID NO: 54521 - DNA, 70 bp, Artificial Sequence
  Synthetic
gccaagcatttaggtgacactatagtggagaggtgattgtagaaagtttcagagctatgctggaaacagc

SEQ ID NO: 54522 - DNA, 70 bp, Artificial Sequence
  Synthetic
gccaagcatttaggtgacactatagtgtgttcttcagtatgagaagtttcagagctatgctggaaacagc

SEQ ID NO: 54523 - DNA, 70 bp, Artificial Sequence
  Synthetic
gccaagcatttaggtgacactatagaaacagcgcagacggcgctagtttcagagctatgctggaaacagc

SEQ ID NO: 54524 - DNA, 70 bp, Artificial Sequence
  Synthetic
gccaagcatttaggtgacactatagttttaatgggaaagattccggtttcagagctatgctggaaacagc

SEQ ID NO: 54525 - DNA, 70 bp, Artificial Sequence
  Synthetic
gccaagcatttaggtgacactatagtggcagctatggttacacaagtttcagagctatgctggaaacagc

SEQ ID NO: 54526 - DNA, 70 bp, Artificial Sequence
  Synthetic
gccaagcatttaggtgacactatagacaagccacacggaaggcccgtttcagagctatgctggaaacagc

SEQ ID NO: 54527 - DNA, 70 bp, Artificial Sequence
  Synthetic
gccaagcatttaggtgacactatagttcggcaagaagactggagagtttcagagctatgctggaaacagc

SEQ ID NO: 54528 - DNA, 70 bp, Artificial Sequence
  Synthetic
gccaagcatttaggtgacactatagaagaagttctaccagtgagcgtttcagagctatgctggaaacagc

SEQ ID NO: 54529 - DNA, 70 bp, Artificial Sequence
  Synthetic
gccaagcatttaggtgacactatagaagcttccactatcatagcagtttcagagctatgctggaaacagc

SEQ ID NO: 54530 - DNA, 70 bp, Artificial Sequence
  Synthetic
gccaagcatttaggtgacactatagcactctcatgaaggggttgtgtttcagagctatgctggaaacagc

SEQ ID NO: 54531 - DNA, 70 bp, Artificial Sequence
  Synthetic
gccaagcatttaggtgacactatagttcaagatgccccgggactggtttcagagctatgctggaaacagc

SEQ ID NO: 54532 - DNA, 70 bp, Artificial Sequence
  Synthetic
gccaagcatttaggtgacactatagaagctttattcatagttcgggtttcagagctatgctggaaacagc

SEQ ID NO: 54533 - DNA, 70 bp, Artificial Sequence
  Synthetic
gccaagcatttaggtgacactataggtctgggtggctcagtcgtggtttcagagctatgctggaaacagc

SEQ ID NO: 54534 - DNA, 70 bp, Artificial Sequence
  Synthetic
gccaagcatttaggtgacactatagacctggtgcgctctgttgtagtttcagagctatgctggaaacagc

SEQ ID NO: 54535 - DNA, 70 bp, Artificial Sequence
  Synthetic
gccaagcatttaggtgacactatagttcatgacaaagcccattaagtttcagagctatgctggaaacagc

SEQ ID NO: 54536 - DNA, 70 bp, Artificial Sequence
  Synthetic
gccaagcatttaggtgacactataggctgtcatcgatcaaagtgtgtttcagagctatgctggaaacagc

SEQ ID NO: 54537 - DNA, 70 bp, Artificial Sequence
  Synthetic
gccaagcatttaggtgacactatagcggcgcgggcctcggctcacgtttcagagctatgctggaaacagc

SEQ ID NO: 54538 - DNA, 70 bp, Artificial Sequence
  Synthetic
gccaagcatttaggtgacactatagctggagctcaagcagtgagggtttcagagctatgctggaaacagc

SEQ ID NO: 54539 - DNA, 70 bp, Artificial Sequence
  Synthetic
gccaagcatttaggtgacactatagtattgtgcactgtcagatctgtttcagagctatgctggaaacagc

SEQ ID NO: 54540 - DNA, 70 bp, Artificial Sequence
  Synthetic
gccaagcatttaggtgacactatagggcccttttttcttacagccgtttcagagctatgctggaaacagc

SEQ ID NO: 54541 - DNA, 70 bp, Artificial Sequence
  Synthetic
gccaagcatttaggtgacactatagtatccaccctctcttttcatgtttcagagctatgctggaaacagc

SEQ ID NO: 54542 - DNA, 70 bp, Artificial Sequence
  Synthetic
gccaagcatttaggtgacactataggaggctgcagtgcgcttcgtgtttcagagctatgctggaaacagc

SEQ ID NO: 54543 - DNA, 70 bp, Artificial Sequence
  Synthetic
gccaagcatttaggtgacactatagctactgctacgccgagaattgtttcagagctatgctggaaacagc

SEQ ID NO: 54544 - DNA, 70 bp, Artificial Sequence
  Synthetic
gccaagcatttaggtgacactatagagggccccaggtcctagtgcgtttcagagctatgctggaaacagc

SEQ ID NO: 54545 - DNA, 70 bp, Artificial Sequence
  Synthetic
gccaagcatttaggtgacactatagacccctctgcacgtctaggcgtttcagagctatgctggaaacagc

SEQ ID NO: 54546 - DNA, 70 bp, Artificial Sequence
  Synthetic
gccaagcatttaggtgacactatagagaggctgaccgtattcgtcgtttcagagctatgctggaaacagc

SEQ ID NO: 54547 - DNA, 70 bp, Artificial Sequence
  Synthetic
gccaagcatttaggtgacactataggttcagttcagcagatgcaggtttcagagctatgctggaaacagc

SEQ ID NO: 54548 - DNA, 70 bp, Artificial Sequence
  Synthetic
gccaagcatttaggtgacactatagttcagtggccagcagagagggtttcagagctatgctggaaacagc

SEQ ID NO: 54549 - DNA, 70 bp, Artificial Sequence
  Synthetic
gccaagcatttaggtgacactatagcgcgtggctggactcacaccgtttcagagctatgctggaaacagc

SEQ ID NO: 54550 - DNA, 70 bp, Artificial Sequence
  Synthetic
gccaagcatttaggtgacactataggaagggacaacaatatgacagtttcagagctatgctggaaacagc

SEQ ID NO: 54551 - DNA, 70 bp, Artificial Sequence
  Synthetic
gccaagcatttaggtgacactatagctcactgctctctagaaacggtttcagagctatgctggaaacagc

SEQ ID NO: 54552 - DNA, 70 bp, Artificial Sequence
  Synthetic
gccaagcatttaggtgacactataggcttttgctgaggtgtgacagtttcagagctatgctggaaacagc

SEQ ID NO: 54553 - DNA, 70 bp, Artificial Sequence
  Synthetic
gccaagcatttaggtgacactatagcttacttaaacagactgtgcgtttcagagctatgctggaaacagc

SEQ ID NO: 54554 - DNA, 70 bp, Artificial Sequence
  Synthetic
gccaagcatttaggtgacactatagcaagtcgttcaataacacgcgtttcagagctatgctggaaacagc

SEQ ID NO: 54555 - DNA, 70 bp, Artificial Sequence
  Synthetic
gccaagcatttaggtgacactatagtacaagaagagtagacatgagtttcagagctatgctggaaacagc

SEQ ID NO: 54556 - DNA, 70 bp, Artificial Sequence
  Synthetic
gccaagcatttaggtgacactatagtggcagagaatatactcaaggtttcagagctatgctggaaacagc

SEQ ID NO: 54557 - DNA, 70 bp, Artificial Sequence
  Synthetic
gccaagcatttaggtgacactatagagtgttttgggagactgaaagtttcagagctatgctggaaacagc

SEQ ID NO: 54558 - DNA, 70 bp, Artificial Sequence
  Synthetic
gccaagcatttaggtgacactatagcatcagcaagaatatcagtggtttcagagctatgctggaaacagc

SEQ ID NO: 54559 - DNA, 70 bp, Artificial Sequence
  Synthetic
gccaagcatttaggtgacactatagctggccctgccagagctcaagtttcagagctatgctggaaacagc

SEQ ID NO: 54560 - DNA, 70 bp, Artificial Sequence
  Synthetic
gccaagcatttaggtgacactatagttcagctgcacagcttctgcgtttcagagctatgctggaaacagc

SEQ ID NO: 54561 - DNA, 70 bp, Artificial Sequence
  Synthetic
gccaagcatttaggtgacactatagcttcatcttgtcaagtcagagtttcagagctatgctggaaacagc

SEQ ID NO: 54562 - DNA, 70 bp, Artificial Sequence
  Synthetic
gccaagcatttaggtgacactatagggcgagcagatctgctgggggtttcagagctatgctggaaacagc

SEQ ID NO: 54563 - DNA, 70 bp, Artificial Sequence
  Synthetic
gccaagcatttaggtgacactatagctctctctctcgttcagggagtttcagagctatgctggaaacagc

SEQ ID NO: 54564 - DNA, 70 bp, Artificial Sequence
  Synthetic
gccaagcatttaggtgacactatagcaccactgggtcttagtccggtttcagagctatgctggaaacagc

SEQ ID NO: 54565 - DNA, 70 bp, Artificial Sequence
  Synthetic
gccaagcatttaggtgacactatagtccaacatgtcagtgatactgtttcagagctatgctggaaacagc

SEQ ID NO: 54566 - DNA, 70 bp, Artificial Sequence
  Synthetic
gccaagcatttaggtgacactatagattgcaaagcgacaacccaagtttcagagctatgctggaaacagc

SEQ ID NO: 54567 - DNA, 70 bp, Artificial Sequence
  Synthetic
gccaagcatttaggtgacactatagctgagggttaacaaggctacgtttcagagctatgctggaaacagc

SEQ ID NO: 54568 - DNA, 70 bp, Artificial Sequence
  Synthetic
gccaagcatttaggtgacactatagacctccaaataccgttaagcgtttcagagctatgctggaaacagc

SEQ ID NO: 54569 - DNA, 70 bp, Artificial Sequence
  Synthetic
gccaagcatttaggtgacactatagagcgagcttagtgatacttggtttcagagctatgctggaaacagc

SEQ ID NO: 54570 - DNA, 70 bp, Artificial Sequence
  Synthetic
gccaagcatttaggtgacactataggaaacagtccaggatctcaagtttcagagctatgctggaaacagc

SEQ ID NO: 54571 - DNA, 70 bp, Artificial Sequence
  Synthetic
gccaagcatttaggtgacactatagcaaactggaagagaactcaggtttcagagctatgctggaaacagc

SEQ ID NO: 54572 - DNA, 70 bp, Artificial Sequence
  Synthetic
gccaagcatttaggtgacactatagtgagcacaagtctctctcaggtttcagagctatgctggaaacagc

SEQ ID NO: 54573 - DNA, 70 bp, Artificial Sequence
  Synthetic
gccaagcatttaggtgacactatagatcatgggcagtgagctcaggtttcagagctatgctggaaacagc

SEQ ID NO: 54574 - DNA, 70 bp, Artificial Sequence
  Synthetic
gccaagcatttaggtgacactatagctgcgcagcacagggctcaggtttcagagctatgctggaaacagc

SEQ ID NO: 54575 - DNA, 70 bp, Artificial Sequence
  Synthetic
gccaagcatttaggtgacactatagtaaatcctgactgttggaaggtttcagagctatgctggaaacagc

SEQ ID NO: 54576 - DNA, 70 bp, Artificial Sequence
  Synthetic
gccaagcatttaggtgacactataggccacccacccacagttcaggtttcagagctatgctggaaacagc

SEQ ID NO: 54577 - DNA, 70 bp, Artificial Sequence
  Synthetic
gccaagcatttaggtgacactatagaatggtgttattgctacaaggtttcagagctatgctggaaacagc

SEQ ID NO: 54578 - DNA, 70 bp, Artificial Sequence
  Synthetic
gccaagcatttaggtgacactatagggtggttctacaatagctgcgtttcagagctatgctggaaacagc

SEQ ID NO: 54579 - DNA, 70 bp, Artificial Sequence
  Synthetic
gccaagcatttaggtgacactataggtcccggaggcggcgctcaggtttcagagctatgctggaaacagc

SEQ ID NO: 54580 - DNA, 70 bp, Artificial Sequence
  Synthetic
gccaagcatttaggtgacactataggggatccccacattgttgaggtttcagagctatgctggaaacagc

SEQ ID NO: 54581 - DNA, 70 bp, Artificial Sequence
  Synthetic
gccaagcatttaggtgacactatagtggcatggttatttaaggaggtttcagagctatgctggaaacagc

SEQ ID NO: 54582 - DNA, 70 bp, Artificial Sequence
  Synthetic
gccaagcatttaggtgacactataggcatctctggagaaacagttgtttcagagctatgctggaaacagc

SEQ ID NO: 54583 - DNA, 70 bp, Artificial Sequence
  Synthetic
gccaagcatttaggtgacactatagatctgaaacagtgctttacggtttcagagctatgctggaaacagc

SEQ ID NO: 54584 - DNA, 70 bp, Artificial Sequence
  Synthetic
gccaagcatttaggtgacactatagtaaggccgatggtcagtgaggtttcagagctatgctggaaacagc

SEQ ID NO: 54585 - DNA, 70 bp, Artificial Sequence
  Synthetic
gccaagcatttaggtgacactatagaaccccagctggggacataagtttcagagctatgctggaaacagc

SEQ ID NO: 54586 - DNA, 70 bp, Artificial Sequence
  Synthetic
gccaagcatttaggtgacactatagacacaagttcggtggcttcagtttcagagctatgctggaaacagc

SEQ ID NO: 54587 - DNA, 70 bp, Artificial Sequence
  Synthetic
gccaagcatttaggtgacactatagtgactgaagtagttcacagagtttcagagctatgctggaaacagc

SEQ ID NO: 54588 - DNA, 70 bp, Artificial Sequence
  Synthetic
gccaagcatttaggtgacactatagtaccaacagcagccatgatagtttcagagctatgctggaaacagc

SEQ ID NO: 54589 - DNA, 70 bp, Artificial Sequence
  Synthetic
gccaagcatttaggtgacactatagtgcaaattatgtcaagcttcgtttcagagctatgctggaaacagc

SEQ ID NO: 54590 - DNA, 70 bp, Artificial Sequence
  Synthetic
gccaagcatttaggtgacactatagaatcgtggcttttctgcgtcgtttcagagctatgctggaaacagc

SEQ ID NO: 54591 - DNA, 70 bp, Artificial Sequence
  Synthetic
gccaagcatttaggtgacactatagggtcggcgagggtcacaagtgtttcagagctatgctggaaacagc

SEQ ID NO: 54592 - DNA, 70 bp, Artificial Sequence
  Synthetic
gccaagcatttaggtgacactatagtttacatgttggcagaaagcgtttcagagctatgctggaaacagc

SEQ ID NO: 54593 - DNA, 70 bp, Artificial Sequence
  Synthetic
gccaagcatttaggtgacactatagctgccatccaatctatgagcgtttcagagctatgctggaaacagc

SEQ ID NO: 54594 - DNA, 70 bp, Artificial Sequence
  Synthetic
gccaagcatttaggtgacactatagccgaagaacgactcagatccgtttcagagctatgctggaaacagc

SEQ ID NO: 54595 - DNA, 70 bp, Artificial Sequence
  Synthetic
gccaagcatttaggtgacactatagcctcgctcagggcagcactggtttcagagctatgctggaaacagc

SEQ ID NO: 54596 - DNA, 70 bp, Artificial Sequence
  Synthetic
gccaagcatttaggtgacactataggagcaggaccacttcaaaacgtttcagagctatgctggaaacagc

SEQ ID NO: 54597 - DNA, 70 bp, Artificial Sequence
  Synthetic
gccaagcatttaggtgacactatagcaggagggtcagcccctgccgtttcagagctatgctggaaacagc

SEQ ID NO: 54598 - DNA, 70 bp, Artificial Sequence
  Synthetic
gccaagcatttaggtgacactatagggaggtcaagttggcctgaagtttcagagctatgctggaaacagc

SEQ ID NO: 54599 - DNA, 70 bp, Artificial Sequence
  Synthetic
gccaagcatttaggtgacactatagttggccgatttcaagccaccgtttcagagctatgctggaaacagc

SEQ ID NO: 54600 - DNA, 70 bp, Artificial Sequence
  Synthetic
gccaagcatttaggtgacactatagagcaagggtcagggcactgcgtttcagagctatgctggaaacagc

SEQ ID NO: 54601 - DNA, 70 bp, Artificial Sequence
  Synthetic
gccaagcatttaggtgacactatagggtgagactgtcaaattcaggtttcagagctatgctggaaacagc

SEQ ID NO: 54602 - DNA, 70 bp, Artificial Sequence
  Synthetic
gccaagcatttaggtgacactatagcaatgacaaggaaagcgatggtttcagagctatgctggaaacagc

SEQ ID NO: 54603 - DNA, 70 bp, Artificial Sequence
  Synthetic
gccaagcatttaggtgacactatagcagcttcgagggagtgctacgtttcagagctatgctggaaacagc

SEQ ID NO: 54604 - DNA, 70 bp, Artificial Sequence
  Synthetic
gccaagcatttaggtgacactataggatgggggccggggcgtcacgtttcagagctatgctggaaacagc

SEQ ID NO: 54605 - DNA, 70 bp, Artificial Sequence
  Synthetic
gccaagcatttaggtgacactatagccgtattctggggcttagtggtttcagagctatgctggaaacagc

SEQ ID NO: 54606 - DNA, 70 bp, Artificial Sequence
  Synthetic
gccaagcatttaggtgacactatagtgatgttggttcacaggtgagtttcagagctatgctggaaacagc

SEQ ID NO: 54607 - DNA, 70 bp, Artificial Sequence
  Synthetic
gccaagcatttaggtgacactatagccagagccttagagattcatgtttcagagctatgctggaaacagc

SEQ ID NO: 54608 - DNA, 70 bp, Artificial Sequence
  Synthetic
gccaagcatttaggtgacactatagcaattaactggtctggaggggtttcagagctatgctggaaacagc

SEQ ID NO: 54609 - DNA, 70 bp, Artificial Sequence
  Synthetic
gccaagcatttaggtgacactataggctgcggcagctgcttctacgtttcagagctatgctggaaacagc

SEQ ID NO: 54610 - DNA, 70 bp, Artificial Sequence
  Synthetic
gccaagcatttaggtgacactatagtgatgtagttgaggatttgtgtttcagagctatgctggaaacagc

SEQ ID NO: 54611 - DNA, 70 bp, Artificial Sequence
  Synthetic
gccaagcatttaggtgacactatagtgtgtatgtggcactttacagtttcagagctatgctggaaacagc

SEQ ID NO: 54612 - DNA, 70 bp, Artificial Sequence
  Synthetic
gccaagcatttaggtgacactatagataggcaaagatttagctccgtttcagagctatgctggaaacagc

SEQ ID NO: 54613 - DNA, 70 bp, Artificial Sequence
  Synthetic
gccaagcatttaggtgacactatagcagcattcatattcgggcttgtttcagagctatgctggaaacagc

SEQ ID NO: 54614 - DNA, 70 bp, Artificial Sequence
  Synthetic
gccaagcatttaggtgacactataggaggtcaatgtgtgtgaagtgtttcagagctatgctggaaacagc

SEQ ID NO: 54615 - DNA, 70 bp, Artificial Sequence
  Synthetic
gccaagcatttaggtgacactataggggggacttggcacttcacagtttcagagctatgctggaaacagc

SEQ ID NO: 54616 - DNA, 70 bp, Artificial Sequence
  Synthetic
gccaagcatttaggtgacactatagaaggccctgtgtctaaaccagtttcagagctatgctggaaacagc

SEQ ID NO: 54617 - DNA, 70 bp, Artificial Sequence
  Synthetic
gccaagcatttaggtgacactatagtagagagtgtctcaggagtggtttcagagctatgctggaaacagc

SEQ ID NO: 54618 - DNA, 70 bp, Artificial Sequence
  Synthetic
gccaagcatttaggtgacactatagcctgaatcgctgcaccccaggtttcagagctatgctggaaacagc

SEQ ID NO: 54619 - DNA, 70 bp, Artificial Sequence
  Synthetic
gccaagcatttaggtgacactatagagcatctgttcaagcagcgggtttcagagctatgctggaaacagc

SEQ ID NO: 54620 - DNA, 70 bp, Artificial Sequence
  Synthetic
gccaagcatttaggtgacactatagcttgaaacattggtggctacgtttcagagctatgctggaaacagc

SEQ ID NO: 54621 - DNA, 70 bp, Artificial Sequence
  Synthetic
gccaagcatttaggtgacactatagctggaaacgctggtaactacgtttcagagctatgctggaaacagc

SEQ ID NO: 54622 - DNA, 70 bp, Artificial Sequence
  Synthetic
gccaagcatttaggtgacactatagcggctcagctctcctcgtccgtttcagagctatgctggaaacagc

SEQ ID NO: 54623 - DNA, 70 bp, Artificial Sequence
  Synthetic
gccaagcatttaggtgacactatagacttgcagaaaaccagtgaagtttcagagctatgctggaaacagc

SEQ ID NO: 54624 - DNA, 70 bp, Artificial Sequence
  Synthetic
gccaagcatttaggtgacactatagacaataggtgctgcagaatggtttcagagctatgctggaaacagc

SEQ ID NO: 54625 - DNA, 70 bp, Artificial Sequence
  Synthetic
gccaagcatttaggtgacactatagggctcaactccagggctttggtttcagagctatgctggaaacagc

SEQ ID NO: 54626 - DNA, 70 bp, Artificial Sequence
  Synthetic
gccaagcatttaggtgacactatagagggctgggctttggagtgagtttcagagctatgctggaaacagc

SEQ ID NO: 54627 - DNA, 70 bp, Artificial Sequence
  Synthetic
gccaagcatttaggtgacactatagggcatggggcctagagcatggtttcagagctatgctggaaacagc

SEQ ID NO: 54628 - DNA, 70 bp, Artificial Sequence
  Synthetic
gccaagcatttaggtgacactatagcattatcgtttggggccccagtttcagagctatgctggaaacagc

SEQ ID NO: 54629 - DNA, 70 bp, Artificial Sequence
  Synthetic
gccaagcatttaggtgacactatagacactgaatgaggtatcatcgtttcagagctatgctggaaacagc

SEQ ID NO: 54630 - DNA, 70 bp, Artificial Sequence
  Synthetic
gccaagcatttaggtgacactatagtcttagaaatagctctggaggtttcagagctatgctggaaacagc

SEQ ID NO: 54631 - DNA, 70 bp, Artificial Sequence
  Synthetic
gccaagcatttaggtgacactatagtgctctgaaagaattccagcgtttcagagctatgctggaaacagc

SEQ ID NO: 54632 - DNA, 70 bp, Artificial Sequence
  Synthetic
gccaagcatttaggtgacactatagtcttctccctctggaaagaagtttcagagctatgctggaaacagc

SEQ ID NO: 54633 - DNA, 70 bp, Artificial Sequence
  Synthetic
gccaagcatttaggtgacactatagagaggaaactggtctttaatgtttcagagctatgctggaaacagc

SEQ ID NO: 54634 - DNA, 70 bp, Artificial Sequence
  Synthetic
gccaagcatttaggtgacactatagaattgttggtgcagaatgtagtttcagagctatgctggaaacagc

SEQ ID NO: 54635 - DNA, 70 bp, Artificial Sequence
  Synthetic
gccaagcatttaggtgacactatagcttcactgatttgttaacccgtttcagagctatgctggaaacagc

SEQ ID NO: 54636 - DNA, 70 bp, Artificial Sequence
  Synthetic
gccaagcatttaggtgacactatagtggcaatttcagcaaggaccgtttcagagctatgctggaaacagc

SEQ ID NO: 54637 - DNA, 70 bp, Artificial Sequence
  Synthetic
gccaagcatttaggtgacactatagacggacggcgcaatgagatcgtttcagagctatgctggaaacagc

SEQ ID NO: 54638 - DNA, 70 bp, Artificial Sequence
  Synthetic
gccaagcatttaggtgacactatagagctacgtggagcctggttcgtttcagagctatgctggaaacagc

SEQ ID NO: 54639 - DNA, 70 bp, Artificial Sequence
  Synthetic
gccaagcatttaggtgacactatagttctcattcgttttctttgggtttcagagctatgctggaaacagc

SEQ ID NO: 54640 - DNA, 70 bp, Artificial Sequence
  Synthetic
gccaagcatttaggtgacactatagataagcttcgagaactttgagtttcagagctatgctggaaacagc

SEQ ID NO: 54641 - DNA, 70 bp, Artificial Sequence
  Synthetic
gccaagcatttaggtgacactatagctagctgctacaatggagaagtttcagagctatgctggaaacagc

SEQ ID NO: 54642 - DNA, 70 bp, Artificial Sequence
  Synthetic
gccaagcatttaggtgacactatagtcccccctacaagagcaaaagtttcagagctatgctggaaacagc

SEQ ID NO: 54643 - DNA, 70 bp, Artificial Sequence
  Synthetic
gccaagcatttaggtgacactatagttaacaccattgaagactctgtttcagagctatgctggaaacagc

SEQ ID NO: 54644 - DNA, 70 bp, Artificial Sequence
  Synthetic
gccaagcatttaggtgacactatagatgagcccttgggaggagtggtttcagagctatgctggaaacagc

SEQ ID NO: 54645 - DNA, 70 bp, Artificial Sequence
  Synthetic
gccaagcatttaggtgacactatagagaccccctcagtggctgatgtttcagagctatgctggaaacagc

SEQ ID NO: 54646 - DNA, 70 bp, Artificial Sequence
  Synthetic
gccaagcatttaggtgacactatagagcacctttggacttgagtggtttcagagctatgctggaaacagc

SEQ ID NO: 54647 - DNA, 70 bp, Artificial Sequence
  Synthetic
gccaagcatttaggtgacactatagacttttggacttgagtgaccgtttcagagctatgctggaaacagc

SEQ ID NO: 54648 - DNA, 70 bp, Artificial Sequence
  Synthetic
gccaagcatttaggtgacactatagtttcatcactgatgaaagacgtttcagagctatgctggaaacagc

SEQ ID NO: 54649 - DNA, 70 bp, Artificial Sequence
  Synthetic
gccaagcatttaggtgacactatagggtgggcttgaaaagttgccgtttcagagctatgctggaaacagc

SEQ ID NO: 54650 - DNA, 70 bp, Artificial Sequence
  Synthetic
gccaagcatttaggtgacactatagaggaccaattaaagagaagagtttcagagctatgctggaaacagc

SEQ ID NO: 54651 - DNA, 70 bp, Artificial Sequence
  Synthetic
gccaagcatttaggtgacactataggacctttatgcccaattcaagtttcagagctatgctggaaacagc

SEQ ID NO: 54652 - DNA, 70 bp, Artificial Sequence
  Synthetic
gccaagcatttaggtgacactatagatagcttcatgctttgtcaggtttcagagctatgctggaaacagc

SEQ ID NO: 54653 - DNA, 70 bp, Artificial Sequence
  Synthetic
gccaagcatttaggtgacactataggcgagtgggcgtcagagcacgtttcagagctatgctggaaacagc

SEQ ID NO: 54654 - DNA, 70 bp, Artificial Sequence
  Synthetic
gccaagcatttaggtgacactataggggagctcatctggcagcaagtttcagagctatgctggaaacagc

SEQ ID NO: 54655 - DNA, 70 bp, Artificial Sequence
  Synthetic
gccaagcatttaggtgacactataggtggagagggctcttcaggagtttcagagctatgctggaaacagc

SEQ ID NO: 54656 - DNA, 70 bp, Artificial Sequence
  Synthetic
gccaagcatttaggtgacactatagtgactctcattcagaattgcgtttcagagctatgctggaaacagc

SEQ ID NO: 54657 - DNA, 70 bp, Artificial Sequence
  Synthetic
gccaagcatttaggtgacactatagcggaggtctgggccatagcagtttcagagctatgctggaaacagc

SEQ ID NO: 54658 - DNA, 70 bp, Artificial Sequence
  Synthetic
gccaagcatttaggtgacactatagcagtgatggttctgcagtgggtttcagagctatgctggaaacagc

SEQ ID NO: 54659 - DNA, 70 bp, Artificial Sequence
  Synthetic
gccaagcatttaggtgacactataggctcaggcgctgatctccacgtttcagagctatgctggaaacagc

SEQ ID NO: 54660 - DNA, 70 bp, Artificial Sequence
  Synthetic
gccaagcatttaggtgacactatagactctggatggtcttgctgcgtttcagagctatgctggaaacagc

SEQ ID NO: 54661 - DNA, 70 bp, Artificial Sequence
  Synthetic
gccaagcatttaggtgacactataggaagcttgaagctgtcatccgtttcagagctatgctggaaacagc

SEQ ID NO: 54662 - DNA, 70 bp, Artificial Sequence
  Synthetic
gccaagcatttaggtgacactataggatggttcacagagcatccggtttcagagctatgctggaaacagc

SEQ ID NO: 54663 - DNA, 70 bp, Artificial Sequence
  Synthetic
gccaagcatttaggtgacactatagggcatgtcctggctacacaggtttcagagctatgctggaaacagc

SEQ ID NO: 54664 - DNA, 70 bp, Artificial Sequence
  Synthetic
gccaagcatttaggtgacactataggcacggtcagtagtcagtgtgtttcagagctatgctggaaacagc

SEQ ID NO: 54665 - DNA, 70 bp, Artificial Sequence
  Synthetic
gccaagcatttaggtgacactatagggatgtcgactcctttgcttgtttcagagctatgctggaaacagc

SEQ ID NO: 54666 - DNA, 70 bp, Artificial Sequence
  Synthetic
gccaagcatttaggtgacactatagctggtaagaatgattgtctcgtttcagagctatgctggaaacagc

SEQ ID NO: 54667 - DNA, 70 bp, Artificial Sequence
  Synthetic
gccaagcatttaggtgacactataggaagggtttagtttggcctggtttcagagctatgctggaaacagc

SEQ ID NO: 54668 - DNA, 70 bp, Artificial Sequence
  Synthetic
gccaagcatttaggtgacactatagccagtccacaggaggtggtggtttcagagctatgctggaaacagc

SEQ ID NO: 54669 - DNA, 70 bp, Artificial Sequence
  Synthetic
gccaagcatttaggtgacactatagtttcccaggccggagtgcaagtttcagagctatgctggaaacagc

SEQ ID NO: 54670 - DNA, 70 bp, Artificial Sequence
  Synthetic
gccaagcatttaggtgacactatagatcaacaacaacagaggattgtttcagagctatgctggaaacagc

SEQ ID NO: 54671 - DNA, 70 bp, Artificial Sequence
  Synthetic
gccaagcatttaggtgacactatagtgattatgactgtgtgagcagtttcagagctatgctggaaacagc

SEQ ID NO: 54672 - DNA, 70 bp, Artificial Sequence
  Synthetic
gccaagcatttaggtgacactatagccccagccatcgcaaactgagtttcagagctatgctggaaacagc

SEQ ID NO: 54673 - DNA, 70 bp, Artificial Sequence
  Synthetic
gccaagcatttaggtgacactataggggtcctgatttacaacgtcgtttcagagctatgctggaaacagc

SEQ ID NO: 54674 - DNA, 70 bp, Artificial Sequence
  Synthetic
gccaagcatttaggtgacactataggcacagtttttcaggtcaatgtttcagagctatgctggaaacagc

SEQ ID NO: 54675 - DNA, 70 bp, Artificial Sequence
  Synthetic
gccaagcatttaggtgacactatagaggccgtggcggaactgagggtttcagagctatgctggaaacagc

SEQ ID NO: 54676 - DNA, 70 bp, Artificial Sequence
  Synthetic
gccaagcatttaggtgacactataggatcggccgaggggctaccagtttcagagctatgctggaaacagc

SEQ ID NO: 54677 - DNA, 70 bp, Artificial Sequence
  Synthetic
gccaagcatttaggtgacactatagccggggatgacctgaactgagtttcagagctatgctggaaacagc

SEQ ID NO: 54678 - DNA, 70 bp, Artificial Sequence
  Synthetic
gccaagcatttaggtgacactatagtggaggccgtggctgcgctggtttcagagctatgctggaaacagc

SEQ ID NO: 54679 - DNA, 70 bp, Artificial Sequence
  Synthetic
gccaagcatttaggtgacactatagctctggcggccctggtgaccgtttcagagctatgctggaaacagc

SEQ ID NO: 54680 - DNA, 70 bp, Artificial Sequence
  Synthetic
gccaagcatttaggtgacactatagctggctggcattggtcaccagtttcagagctatgctggaaacagc

SEQ ID NO: 54681 - DNA, 70 bp, Artificial Sequence
  Synthetic
gccaagcatttaggtgacactatagccccccaaggctcagggccagtttcagagctatgctggaaacagc

SEQ ID NO: 54682 - DNA, 70 bp, Artificial Sequence
  Synthetic
gccaagcatttaggtgacactatagatcggcgtgcaaaactgaaagtttcagagctatgctggaaacagc

SEQ ID NO: 54683 - DNA, 70 bp, Artificial Sequence
  Synthetic
gccaagcatttaggtgacactatagcaatgtaggcttctgtgagcgtttcagagctatgctggaaacagc

SEQ ID NO: 54684 - DNA, 70 bp, Artificial Sequence
  Synthetic
gccaagcatttaggtgacactataggctgcacaacctctttatgcgtttcagagctatgctggaaacagc

SEQ ID NO: 54685 - DNA, 70 bp, Artificial Sequence
  Synthetic
gccaagcatttaggtgacactatagcacacatgcagatcacaaaggtttcagagctatgctggaaacagc

SEQ ID NO: 54686 - DNA, 70 bp, Artificial Sequence
  Synthetic
gccaagcatttaggtgacactatagggcatgagctctcccctcaggtttcagagctatgctggaaacagc

SEQ ID NO: 54687 - DNA, 70 bp, Artificial Sequence
  Synthetic
gccaagcatttaggtgacactatagttcagtctagtctccaaactgtttcagagctatgctggaaacagc

SEQ ID NO: 54688 - DNA, 70 bp, Artificial Sequence
  Synthetic
gccaagcatttaggtgacactatagatgaggagccgggtacctaggtttcagagctatgctggaaacagc

SEQ ID NO: 54689 - DNA, 70 bp, Artificial Sequence
  Synthetic
gccaagcatttaggtgacactatagagaccttgggggacggagatgtttcagagctatgctggaaacagc

SEQ ID NO: 54690 - DNA, 70 bp, Artificial Sequence
  Synthetic
gccaagcatttaggtgacactatagcgaccctgggggacagaagtgtttcagagctatgctggaaacagc

SEQ ID NO: 54691 - DNA, 70 bp, Artificial Sequence
  Synthetic
gccaagcatttaggtgacactatagctctgaaatcactgaaatcggtttcagagctatgctggaaacagc

SEQ ID NO: 54692 - DNA, 70 bp, Artificial Sequence
  Synthetic
gccaagcatttaggtgacactatagagctaagacgtagtgccccagtttcagagctatgctggaaacagc

SEQ ID NO: 54693 - DNA, 70 bp, Artificial Sequence
  Synthetic
gccaagcatttaggtgacactatagaggagtcctcttccaaaaatgtttcagagctatgctggaaacagc

SEQ ID NO: 54694 - DNA, 70 bp, Artificial Sequence
  Synthetic
gccaagcatttaggtgacactatagtttgtcgtcatcttgttcatgtttcagagctatgctggaaacagc

SEQ ID NO: 54695 - DNA, 70 bp, Artificial Sequence
  Synthetic
gccaagcatttaggtgacactataggtggctttgcattcagtaaggtttcagagctatgctggaaacagc

SEQ ID NO: 54696 - DNA, 70 bp, Artificial Sequence
  Synthetic
gccaagcatttaggtgacactatagatttcatcagcttcatcatcgtttcagagctatgctggaaacagc

SEQ ID NO: 54697 - DNA, 70 bp, Artificial Sequence
  Synthetic
gccaagcatttaggtgacactatagccccacacacacactgcagggtttcagagctatgctggaaacagc

SEQ ID NO: 54698 - DNA, 70 bp, Artificial Sequence
  Synthetic
gccaagcatttaggtgacactataggcaatgttccagtctcaattgtttcagagctatgctggaaacagc

SEQ ID NO: 54699 - DNA, 70 bp, Artificial Sequence
  Synthetic
gccaagcatttaggtgacactatagacttacttcagctatgactggtttcagagctatgctggaaacagc

SEQ ID NO: 54700 - DNA, 70 bp, Artificial Sequence
  Synthetic
gccaagcatttaggtgacactataggacattcctcagtgttcagagtttcagagctatgctggaaacagc

SEQ ID NO: 54701 - DNA, 70 bp, Artificial Sequence
  Synthetic
gccaagcatttaggtgacactatagtaattgcacagtactcccaggtttcagagctatgctggaaacagc

SEQ ID NO: 54702 - DNA, 70 bp, Artificial Sequence
  Synthetic
gccaagcatttaggtgacactatagtgtcccgctggagggtcagggtttcagagctatgctggaaacagc

SEQ ID NO: 54703 - DNA, 70 bp, Artificial Sequence
  Synthetic
gccaagcatttaggtgacactatagccggctgcaggggcctcagggtttcagagctatgctggaaacagc

SEQ ID NO: 54704 - DNA, 70 bp, Artificial Sequence
  Synthetic
gccaagcatttaggtgacactataggtcagtcgaatgaaatgagcgtttcagagctatgctggaaacagc

SEQ ID NO: 54705 - DNA, 70 bp, Artificial Sequence
  Synthetic
gccaagcatttaggtgacactatagtgtaggcaatgagcacccaggtttcagagctatgctggaaacagc

SEQ ID NO: 54706 - DNA, 70 bp, Artificial Sequence
  Synthetic
gccaagcatttaggtgacactatagggcccaacagcattagtccggtttcagagctatgctggaaacagc

SEQ ID NO: 54707 - DNA, 70 bp, Artificial Sequence
  Synthetic
gccaagcatttaggtgacactatagaaagagaagccggagtaggagtttcagagctatgctggaaacagc

SEQ ID NO: 54708 - DNA, 70 bp, Artificial Sequence
  Synthetic
gccaagcatttaggtgacactataggatcaggaagtggacattgagtttcagagctatgctggaaacagc

SEQ ID NO: 54709 - DNA, 70 bp, Artificial Sequence
  Synthetic
gccaagcatttaggtgacactatagtgacatgacatcttacttgcgtttcagagctatgctggaaacagc

SEQ ID NO: 54710 - DNA, 70 bp, Artificial Sequence
  Synthetic
gccaagcatttaggtgacactatagagccgttcattttacagtgggtttcagagctatgctggaaacagc

SEQ ID NO: 54711 - DNA, 70 bp, Artificial Sequence
  Synthetic
gccaagcatttaggtgacactatagggcagcggcgtgttgcctacgtttcagagctatgctggaaacagc

SEQ ID NO: 54712 - DNA, 70 bp, Artificial Sequence
  Synthetic
gccaagcatttaggtgacactatagcaccttgaccaataggtcaagtttcagagctatgctggaaacagc

SEQ ID NO: 54713 - DNA, 70 bp, Artificial Sequence
  Synthetic
gccaagcatttaggtgacactatagaatatctgcaagtctgtgtggtttcagagctatgctggaaacagc

SEQ ID NO: 54714 - DNA, 70 bp, Artificial Sequence
  Synthetic
gccaagcatttaggtgacactataggcctctttcaggaaaagtatgtttcagagctatgctggaaacagc

SEQ ID NO: 54715 - DNA, 70 bp, Artificial Sequence
  Synthetic
gccaagcatttaggtgacactatagagaccccaagagagcattctgtttcagagctatgctggaaacagc

SEQ ID NO: 54716 - DNA, 70 bp, Artificial Sequence
  Synthetic
gccaagcatttaggtgacactatagggggatatgatggctttgctgtttcagagctatgctggaaacagc

SEQ ID NO: 54717 - DNA, 70 bp, Artificial Sequence
  Synthetic
gccaagcatttaggtgacactatagggccaaagggcacactcagagtttcagagctatgctggaaacagc

SEQ ID NO: 54718 - DNA, 70 bp, Artificial Sequence
  Synthetic
gccaagcatttaggtgacactatagagatcagctggtttccatttgtttcagagctatgctggaaacagc

SEQ ID NO: 54719 - DNA, 70 bp, Artificial Sequence
  Synthetic
gccaagcatttaggtgacactatagcactaaggcaactcatggaggtttcagagctatgctggaaacagc

SEQ ID NO: 54720 - DNA, 70 bp, Artificial Sequence
  Synthetic
gccaagcatttaggtgacactatagctggcgaggggcgctctagggtttcagagctatgctggaaacagc

SEQ ID NO: 54721 - DNA, 70 bp, Artificial Sequence
  Synthetic
gccaagcatttaggtgacactataggcgggtctttggcttctagggtttcagagctatgctggaaacagc

SEQ ID NO: 54722 - DNA, 70 bp, Artificial Sequence
  Synthetic
gccaagcatttaggtgacactatagtttgagatacagcgggtgtggtttcagagctatgctggaaacagc

SEQ ID NO: 54723 - DNA, 70 bp, Artificial Sequence
  Synthetic
gccaagcatttaggtgacactatagggttcactttttcaagcagtgtttcagagctatgctggaaacagc

SEQ ID NO: 54724 - DNA, 70 bp, Artificial Sequence
  Synthetic
gccaagcatttaggtgacactatagtgaagaattactcagagcttgtttcagagctatgctggaaacagc

SEQ ID NO: 54725 - DNA, 70 bp, Artificial Sequence
  Synthetic
gccaagcatttaggtgacactatagccctggcaggctagttgtatgtttcagagctatgctggaaacagc

SEQ ID NO: 54726 - DNA, 70 bp, Artificial Sequence
  Synthetic
gccaagcatttaggtgacactatagtcagcccaggctgactgagcgtttcagagctatgctggaaacagc

SEQ ID NO: 54727 - DNA, 70 bp, Artificial Sequence
  Synthetic
gccaagcatttaggtgacactatagtttcactttgtcacccagtcgtttcagagctatgctggaaacagc

SEQ ID NO: 54728 - DNA, 70 bp, Artificial Sequence
  Synthetic
gccaagcatttaggtgacactatagcatctcttcttctaaggcttgtttcagagctatgctggaaacagc

SEQ ID NO: 54729 - DNA, 70 bp, Artificial Sequence
  Synthetic
gccaagcatttaggtgacactatagacaggatgctggagagaagtgtttcagagctatgctggaaacagc

SEQ ID NO: 54730 - DNA, 70 bp, Artificial Sequence
  Synthetic
gccaagcatttaggtgacactatagttggactcactgaagaatcggtttcagagctatgctggaaacagc

SEQ ID NO: 54731 - DNA, 70 bp, Artificial Sequence
  Synthetic
gccaagcatttaggtgacactatagcgcagccatcttgctgggtcgtttcagagctatgctggaaacagc

SEQ ID NO: 54732 - DNA, 70 bp, Artificial Sequence
  Synthetic
gccaagcatttaggtgacactatagtcaagaccctgggctcaggggtttcagagctatgctggaaacagc

SEQ ID NO: 54733 - DNA, 70 bp, Artificial Sequence
  Synthetic
gccaagcatttaggtgacactatagtagcacagaaccctctctttgtttcagagctatgctggaaacagc

SEQ ID NO: 54734 - DNA, 70 bp, Artificial Sequence
  Synthetic
gccaagcatttaggtgacactataggtttaatgcacaggtgtgaggtttcagagctatgctggaaacagc

SEQ ID NO: 54735 - DNA, 70 bp, Artificial Sequence
  Synthetic
gccaagcatttaggtgacactatagcagagatccagatggtttgagtttcagagctatgctggaaacagc

SEQ ID NO: 54736 - DNA, 70 bp, Artificial Sequence
  Synthetic
gccaagcatttaggtgacactatagtggctatatgcggctgcagcgtttcagagctatgctggaaacagc

SEQ ID NO: 54737 - DNA, 70 bp, Artificial Sequence
  Synthetic
gccaagcatttaggtgacactatagtccccaaaacgtgcttaaccgtttcagagctatgctggaaacagc

SEQ ID NO: 54738 - DNA, 70 bp, Artificial Sequence
  Synthetic
gccaagcatttaggtgacactatagatcagttggcaggttcaaccgtttcagagctatgctggaaacagc

SEQ ID NO: 54739 - DNA, 70 bp, Artificial Sequence
  Synthetic
gccaagcatttaggtgacactataggcttggcttcttatccaagtgtttcagagctatgctggaaacagc

SEQ ID NO: 54740 - DNA, 70 bp, Artificial Sequence
  Synthetic
gccaagcatttaggtgacactatagtccacctacactgcaagaaggtttcagagctatgctggaaacagc

SEQ ID NO: 54741 - DNA, 70 bp, Artificial Sequence
  Synthetic
gccaagcatttaggtgacactatagagctcaactcgtgaactactgtttcagagctatgctggaaacagc

SEQ ID NO: 54742 - DNA, 70 bp, Artificial Sequence
  Synthetic
gccaagcatttaggtgacactatagccagacggcagtgaactcaggtttcagagctatgctggaaacagc

SEQ ID NO: 54743 - DNA, 70 bp, Artificial Sequence
  Synthetic
gccaagcatttaggtgacactatagcatgctcaccaactataagtgtttcagagctatgctggaaacagc

SEQ ID NO: 54744 - DNA, 70 bp, Artificial Sequence
  Synthetic
gccaagcatttaggtgacactatagtggagaaccctgcttctggcgtttcagagctatgctggaaacagc

SEQ ID NO: 54745 - DNA, 70 bp, Artificial Sequence
  Synthetic
gccaagcatttaggtgacactatagccctccagtgtttatatgtagtttcagagctatgctggaaacagc

SEQ ID NO: 54746 - DNA, 70 bp, Artificial Sequence
  Synthetic
gccaagcatttaggtgacactatagggatactggctgagttttgtgtttcagagctatgctggaaacagc

SEQ ID NO: 54747 - DNA, 70 bp, Artificial Sequence
  Synthetic
gccaagcatttaggtgacactatagaggggtggaatcaccatcaggtttcagagctatgctggaaacagc

SEQ ID NO: 54748 - DNA, 70 bp, Artificial Sequence
  Synthetic
gccaagcatttaggtgacactataggggcaggctacttgtccctcgtttcagagctatgctggaaacagc

SEQ ID NO: 54749 - DNA, 70 bp, Artificial Sequence
  Synthetic
gccaagcatttaggtgacactatagcgtggcatcatcagcagtgagtttcagagctatgctggaaacagc

SEQ ID NO: 54750 - DNA, 70 bp, Artificial Sequence
  Synthetic
gccaagcatttaggtgacactatagggcggcgcccaagaagaaatgtttcagagctatgctggaaacagc

SEQ ID NO: 54751 - DNA, 70 bp, Artificial Sequence
  Synthetic
gccaagcatttaggtgacactatagggcagccaagccaaagaagggtttcagagctatgctggaaacagc

SEQ ID NO: 54752 - DNA, 70 bp, Artificial Sequence
  Synthetic
gccaagcatttaggtgacactatagacaaagctaagggcaagtaagtttcagagctatgctggaaacagc

SEQ ID NO: 54753 - DNA, 70 bp, Artificial Sequence
  Synthetic
gccaagcatttaggtgacactatagccgcggtgggcgggctcactgtttcagagctatgctggaaacagc

SEQ ID NO: 54754 - DNA, 70 bp, Artificial Sequence
  Synthetic
gccaagcatttaggtgacactatagtcgccgcattcgcggagagagtttcagagctatgctggaaacagc

SEQ ID NO: 54755 - DNA, 70 bp, Artificial Sequence
  Synthetic
gccaagcatttaggtgacactatagacgtcgtatccgcggcgagagtttcagagctatgctggaaacagc

SEQ ID NO: 54756 - DNA, 70 bp, Artificial Sequence
  Synthetic
gccaagcatttaggtgacactatagcgcactctgtatggcttcgggtttcagagctatgctggaaacagc

SEQ ID NO: 54757 - DNA, 70 bp, Artificial Sequence
  Synthetic
gccaagcatttaggtgacactatagcgcactctttatggcttcgggtttcagagctatgctggaaacagc

SEQ ID NO: 54758 - DNA, 70 bp, Artificial Sequence
  Synthetic
gccaagcatttaggtgacactatagctttacggcttcggtggctagtttcagagctatgctggaaacagc

SEQ ID NO: 54759 - DNA, 70 bp, Artificial Sequence
  Synthetic
gccaagcatttaggtgacactatagcgcaccctctacggtttcgggtttcagagctatgctggaaacagc

SEQ ID NO: 54760 - DNA, 70 bp, Artificial Sequence
  Synthetic
gccaagcatttaggtgacactatagcacaaggcaaagggcaagtggtttcagagctatgctggaaacagc

SEQ ID NO: 54761 - DNA, 70 bp, Artificial Sequence
  Synthetic
gccaagcatttaggtgacactatagccgccgcatccgtggagagcgtttcagagctatgctggaaacagc

SEQ ID NO: 54762 - DNA, 70 bp, Artificial Sequence
  Synthetic
gccaagcatttaggtgacactatagcctgtacggcttcggaggctgtttcagagctatgctggaaacagc

SEQ ID NO: 54763 - DNA, 70 bp, Artificial Sequence
  Synthetic
gccaagcatttaggtgacactatagcacaaggccaagggcaagtggtttcagagctatgctggaaacagc

SEQ ID NO: 54764 - DNA, 70 bp, Artificial Sequence
  Synthetic
gccaagcatttaggtgacactatagacgccgaggaacgcctcactgtttcagagctatgctggaaacagc

SEQ ID NO: 54765 - DNA, 70 bp, Artificial Sequence
  Synthetic
gccaagcatttaggtgacactatagggcttgtgatagcaacctgagtttcagagctatgctggaaacagc

SEQ ID NO: 54766 - DNA, 70 bp, Artificial Sequence
  Synthetic
gccaagcatttaggtgacactatagagctgactcttttctgatgagtttcagagctatgctggaaacagc

SEQ ID NO: 54767 - DNA, 70 bp, Artificial Sequence
  Synthetic
gccaagcatttaggtgacactataggttggagagaggctaagcgtgtttcagagctatgctggaaacagc

SEQ ID NO: 54768 - DNA, 70 bp, Artificial Sequence
  Synthetic
gccaagcatttaggtgacactatagagagaacacgtcttacaggagtttcagagctatgctggaaacagc

SEQ ID NO: 54769 - DNA, 70 bp, Artificial Sequence
  Synthetic
gccaagcatttaggtgacactataggggcgtgcggttacgcacaggtttcagagctatgctggaaacagc

SEQ ID NO: 54770 - DNA, 70 bp, Artificial Sequence
  Synthetic
gccaagcatttaggtgacactataggcctgccgcatccgtgaggcgtttcagagctatgctggaaacagc

SEQ ID NO: 54771 - DNA, 70 bp, Artificial Sequence
  Synthetic
gccaagcatttaggtgacactataggcgcagttgactcgtgtctggtttcagagctatgctggaaacagc

SEQ ID NO: 54772 - DNA, 70 bp, Artificial Sequence
  Synthetic
gccaagcatttaggtgacactataggcaggcacagaaggagaactgtttcagagctatgctggaaacagc

SEQ ID NO: 54773 - DNA, 70 bp, Artificial Sequence
  Synthetic
gccaagcatttaggtgacactatagagacatcagaggacacactcgtttcagagctatgctggaaacagc

SEQ ID NO: 54774 - DNA, 70 bp, Artificial Sequence
  Synthetic
gccaagcatttaggtgacactatagaacaccactgtattccagccgtttcagagctatgctggaaacagc

SEQ ID NO: 54775 - DNA, 70 bp, Artificial Sequence
  Synthetic
gccaagcatttaggtgacactatagtgagagactcatcagagcccgtttcagagctatgctggaaacagc

SEQ ID NO: 54776 - DNA, 70 bp, Artificial Sequence
  Synthetic
gccaagcatttaggtgacactatagtacttccggaagccttgctcgtttcagagctatgctggaaacagc

SEQ ID NO: 54777 - DNA, 70 bp, Artificial Sequence
  Synthetic
gccaagcatttaggtgacactatagcctgggtccaattattcagagtttcagagctatgctggaaacagc

SEQ ID NO: 54778 - DNA, 70 bp, Artificial Sequence
  Synthetic
gccaagcatttaggtgacactatagcatatgtgtccagtgtccccgtttcagagctatgctggaaacagc

SEQ ID NO: 54779 - DNA, 70 bp, Artificial Sequence
  Synthetic
gccaagcatttaggtgacactatagctgctccctcagtcatgctagtttcagagctatgctggaaacagc

SEQ ID NO: 54780 - DNA, 70 bp, Artificial Sequence
  Synthetic
gccaagcatttaggtgacactatagcagtatttcacagggtccccgtttcagagctatgctggaaacagc

SEQ ID NO: 54781 - DNA, 70 bp, Artificial Sequence
  Synthetic
gccaagcatttaggtgacactatagcaacgaggatctgcataaacgtttcagagctatgctggaaacagc

SEQ ID NO: 54782 - DNA, 70 bp, Artificial Sequence
  Synthetic
gccaagcatttaggtgacactatagttccaggatgggattcacaagtttcagagctatgctggaaacagc

SEQ ID NO: 54783 - DNA, 70 bp, Artificial Sequence
  Synthetic
gccaagcatttaggtgacactatagatgggattcataagagccctgtttcagagctatgctggaaacagc

SEQ ID NO: 54784 - DNA, 70 bp, Artificial Sequence
  Synthetic
gccaagcatttaggtgacactatagatccgtcaaaggagtcagaagtttcagagctatgctggaaacagc

SEQ ID NO: 54785 - DNA, 70 bp, Artificial Sequence
  Synthetic
gccaagcatttaggtgacactatagcctcaagggcctccaccagcgtttcagagctatgctggaaacagc

SEQ ID NO: 54786 - DNA, 70 bp, Artificial Sequence
  Synthetic
gccaagcatttaggtgacactataggggctgatcttcctcgggctgtttcagagctatgctggaaacagc

SEQ ID NO: 54787 - DNA, 70 bp, Artificial Sequence
  Synthetic
gccaagcatttaggtgacactatagaagtcctcaggagtcagtgcgtttcagagctatgctggaaacagc

SEQ ID NO: 54788 - DNA, 70 bp, Artificial Sequence
  Synthetic
gccaagcatttaggtgacactatagcacctccatgtgccttacaggtttcagagctatgctggaaacagc

SEQ ID NO: 54789 - DNA, 70 bp, Artificial Sequence
  Synthetic
gccaagcatttaggtgacactatagatctacttcaggaatcagaagtttcagagctatgctggaaacagc

SEQ ID NO: 54790 - DNA, 70 bp, Artificial Sequence
  Synthetic
gccaagcatttaggtgacactatagggtcatctgcatttcagctcgtttcagagctatgctggaaacagc

SEQ ID NO: 54791 - DNA, 70 bp, Artificial Sequence
  Synthetic
gccaagcatttaggtgacactatagcactctggacttcagccaacgtttcagagctatgctggaaacagc

SEQ ID NO: 54792 - DNA, 70 bp, Artificial Sequence
  Synthetic
gccaagcatttaggtgacactatagcactctggacttcacccaacgtttcagagctatgctggaaacagc

SEQ ID NO: 54793 - DNA, 70 bp, Artificial Sequence
  Synthetic
gccaagcatttaggtgacactatagagctgtgagactcagaccccgtttcagagctatgctggaaacagc

SEQ ID NO: 54794 - DNA, 70 bp, Artificial Sequence
  Synthetic
gccaagcatttaggtgacactatagaaacagagggagctactctcgtttcagagctatgctggaaacagc

SEQ ID NO: 54795 - DNA, 70 bp, Artificial Sequence
  Synthetic
gccaagcatttaggtgacactatagttggcaccatcttatgaaaagtttcagagctatgctggaaacagc

SEQ ID NO: 54796 - DNA, 70 bp, Artificial Sequence
  Synthetic
gccaagcatttaggtgacactatagctgcggtcgctgctgtgctggtttcagagctatgctggaaacagc

SEQ ID NO: 54797 - DNA, 70 bp, Artificial Sequence
  Synthetic
gccaagcatttaggtgacactatagcgcccggcattaccgccgttgtttcagagctatgctggaaacagc

SEQ ID NO: 54798 - DNA, 70 bp, Artificial Sequence
  Synthetic
gccaagcatttaggtgacactatagaggcacgggcccctgtaggagtttcagagctatgctggaaacagc

SEQ ID NO: 54799 - DNA, 70 bp, Artificial Sequence
  Synthetic
gccaagcatttaggtgacactatagtgtttcatttcgtcagcattgtttcagagctatgctggaaacagc

SEQ ID NO: 54800 - DNA, 70 bp, Artificial Sequence
  Synthetic
gccaagcatttaggtgacactataggagccagcccaaggcgcgctgtttcagagctatgctggaaacagc

SEQ ID NO: 54801 - DNA, 70 bp, Artificial Sequence
  Synthetic
gccaagcatttaggtgacactatagggcacccgctgggcattacagtttcagagctatgctggaaacagc

SEQ ID NO: 54802 - DNA, 70 bp, Artificial Sequence
  Synthetic
gccaagcatttaggtgacactatagcgggaaccagtacagggtctgtttcagagctatgctggaaacagc

SEQ ID NO: 54803 - DNA, 70 bp, Artificial Sequence
  Synthetic
gccaagcatttaggtgacactatagggcatcagcatcgaaggggcgtttcagagctatgctggaaacagc

SEQ ID NO: 54804 - DNA, 70 bp, Artificial Sequence
  Synthetic
gccaagcatttaggtgacactatagaactccgtatcaaagagcttgtttcagagctatgctggaaacagc

SEQ ID NO: 54805 - DNA, 70 bp, Artificial Sequence
  Synthetic
gccaagcatttaggtgacactatagagaaggtagaagaagagagggtttcagagctatgctggaaacagc

SEQ ID NO: 54806 - DNA, 70 bp, Artificial Sequence
  Synthetic
gccaagcatttaggtgacactataggccctggatgatgactgatcgtttcagagctatgctggaaacagc

SEQ ID NO: 54807 - DNA, 70 bp, Artificial Sequence
  Synthetic
gccaagcatttaggtgacactataggtgccccacaaaccagttaagtttcagagctatgctggaaacagc

SEQ ID NO: 54808 - DNA, 70 bp, Artificial Sequence
  Synthetic
gccaagcatttaggtgacactatagctctgaaagtcctgtgtcacgtttcagagctatgctggaaacagc

SEQ ID NO: 54809 - DNA, 70 bp, Artificial Sequence
  Synthetic
gccaagcatttaggtgacactatagctttggagagttccttagtagtttcagagctatgctggaaacagc

SEQ ID NO: 54810 - DNA, 70 bp, Artificial Sequence
  Synthetic
gccaagcatttaggtgacactatagtccccctacccctactaaacgtttcagagctatgctggaaacagc

SEQ ID NO: 54811 - DNA, 70 bp, Artificial Sequence
  Synthetic
gccaagcatttaggtgacactataggtgaacagactcgatcgttagtttcagagctatgctggaaacagc

SEQ ID NO: 54812 - DNA, 70 bp, Artificial Sequence
  Synthetic
gccaagcatttaggtgacactatagtgggcccgcccactcctcacgtttcagagctatgctggaaacagc

SEQ ID NO: 54813 - DNA, 70 bp, Artificial Sequence
  Synthetic
gccaagcatttaggtgacactatagctcgcaggagtcctcggagggtttcagagctatgctggaaacagc

SEQ ID NO: 54814 - DNA, 70 bp, Artificial Sequence
  Synthetic
gccaagcatttaggtgacactatagaagaggcagacctaggaaatgtttcagagctatgctggaaacagc

SEQ ID NO: 54815 - DNA, 70 bp, Artificial Sequence
  Synthetic
gccaagcatttaggtgacactataggacaattcagtgactcctttgtttcagagctatgctggaaacagc

SEQ ID NO: 54816 - DNA, 70 bp, Artificial Sequence
  Synthetic
gccaagcatttaggtgacactataggatatataagattgcccggggtttcagagctatgctggaaacagc

SEQ ID NO: 54817 - DNA, 70 bp, Artificial Sequence
  Synthetic
gccaagcatttaggtgacactataggtctgccgaagaggactagggtttcagagctatgctggaaacagc

SEQ ID NO: 54818 - DNA, 70 bp, Artificial Sequence
  Synthetic
gccaagcatttaggtgacactatagtgaagaggatgaggaggagggtttcagagctatgctggaaacagc

SEQ ID NO: 54819 - DNA, 70 bp, Artificial Sequence
  Synthetic
gccaagcatttaggtgacactatagagatgaagatgaggaggaaggtttcagagctatgctggaaacagc

SEQ ID NO: 54820 - DNA, 70 bp, Artificial Sequence
  Synthetic
gccaagcatttaggtgacactatagggaagatgaagaagaggagggtttcagagctatgctggaaacagc

SEQ ID NO: 54821 - DNA, 70 bp, Artificial Sequence
  Synthetic
gccaagcatttaggtgacactatagaaagagtcaggcagagctgagtttcagagctatgctggaaacagc

SEQ ID NO: 54822 - DNA, 70 bp, Artificial Sequence
  Synthetic
gccaagcatttaggtgacactataggcaaggggctcagagtttacgtttcagagctatgctggaaacagc

SEQ ID NO: 54823 - DNA, 70 bp, Artificial Sequence
  Synthetic
gccaagcatttaggtgacactatagccattcaagtcaagcattgagtttcagagctatgctggaaacagc

SEQ ID NO: 54824 - DNA, 70 bp, Artificial Sequence
  Synthetic
gccaagcatttaggtgacactatagggctattcaggctgtcttctgtttcagagctatgctggaaacagc

SEQ ID NO: 54825 - DNA, 70 bp, Artificial Sequence
  Synthetic
gccaagcatttaggtgacactatagagcagctgtcattagtaatggtttcagagctatgctggaaacagc

SEQ ID NO: 54826 - DNA, 70 bp, Artificial Sequence
  Synthetic
gccaagcatttaggtgacactatagatgcccggcgtcccgtctaagtttcagagctatgctggaaacagc

SEQ ID NO: 54827 - DNA, 70 bp, Artificial Sequence
  Synthetic
gccaagcatttaggtgacactatagcttaacattccacagatggggtttcagagctatgctggaaacagc

SEQ ID NO: 54828 - DNA, 70 bp, Artificial Sequence
  Synthetic
gccaagcatttaggtgacactatagaggtttagcagacaacctcggtttcagagctatgctggaaacagc

SEQ ID NO: 54829 - DNA, 70 bp, Artificial Sequence
  Synthetic
gccaagcatttaggtgacactatagccagcacactgtcagtaaaggtttcagagctatgctggaaacagc

SEQ ID NO: 54830 - DNA, 70 bp, Artificial Sequence
  Synthetic
gccaagcatttaggtgacactatagaaagacactgattcaatcaggtttcagagctatgctggaaacagc

SEQ ID NO: 54831 - DNA, 70 bp, Artificial Sequence
  Synthetic
gccaagcatttaggtgacactatagaagcaggaagctggaaaggagtttcagagctatgctggaaacagc

SEQ ID NO: 54832 - DNA, 70 bp, Artificial Sequence
  Synthetic
gccaagcatttaggtgacactatagactgaatctgtagataacgagtttcagagctatgctggaaacagc

SEQ ID NO: 54833 - DNA, 70 bp, Artificial Sequence
  Synthetic
gccaagcatttaggtgacactatagaagtaatatggaggaacagtgtttcagagctatgctggaaacagc

SEQ ID NO: 54834 - DNA, 70 bp, Artificial Sequence
  Synthetic
gccaagcatttaggtgacactatagagaagaggaagaaggaaaaggtttcagagctatgctggaaacagc

SEQ ID NO: 54835 - DNA, 70 bp, Artificial Sequence
  Synthetic
gccaagcatttaggtgacactatagcctggcttattctgccactggtttcagagctatgctggaaacagc

SEQ ID NO: 54836 - DNA, 70 bp, Artificial Sequence
  Synthetic
gccaagcatttaggtgacactatagattctttgctgtcacagtccgtttcagagctatgctggaaacagc

SEQ ID NO: 54837 - DNA, 70 bp, Artificial Sequence
  Synthetic
gccaagcatttaggtgacactataggcatgtttggaagtcggaatgtttcagagctatgctggaaacagc

SEQ ID NO: 54838 - DNA, 70 bp, Artificial Sequence
  Synthetic
gccaagcatttaggtgacactatagctatggagtgtcaagaatcagtttcagagctatgctggaaacagc

SEQ ID NO: 54839 - DNA, 70 bp, Artificial Sequence
  Synthetic
gccaagcatttaggtgacactatagccagcatgcctgcattcacagtttcagagctatgctggaaacagc

SEQ ID NO: 54840 - DNA, 70 bp, Artificial Sequence
  Synthetic
gccaagcatttaggtgacactatagggtgcttcacatgtagtaccgtttcagagctatgctggaaacagc

SEQ ID NO: 54841 - DNA, 70 bp, Artificial Sequence
  Synthetic
gccaagcatttaggtgacactatagtgggttgctgataaaactaagtttcagagctatgctggaaacagc

SEQ ID NO: 54842 - DNA, 70 bp, Artificial Sequence
  Synthetic
gccaagcatttaggtgacactatagcactgctccacgcggtcactgtttcagagctatgctggaaacagc

SEQ ID NO: 54843 - DNA, 70 bp, Artificial Sequence
  Synthetic
gccaagcatttaggtgacactatagcggcaggcggggctcacaccgtttcagagctatgctggaaacagc

SEQ ID NO: 54844 - DNA, 70 bp, Artificial Sequence
  Synthetic
gccaagcatttaggtgacactatagcaacaagctcgactactgacgtttcagagctatgctggaaacagc

SEQ ID NO: 54845 - DNA, 70 bp, Artificial Sequence
  Synthetic
gccaagcatttaggtgacactatagttccgtgccgctgctacggcgtttcagagctatgctggaaacagc

SEQ ID NO: 54846 - DNA, 70 bp, Artificial Sequence
  Synthetic
gccaagcatttaggtgacactatagggcccaggtgccgtggttacgtttcagagctatgctggaaacagc

SEQ ID NO: 54847 - DNA, 70 bp, Artificial Sequence
  Synthetic
gccaagcatttaggtgacactatagagtggtgtgtgggcatcaccgtttcagagctatgctggaaacagc

SEQ ID NO: 54848 - DNA, 70 bp, Artificial Sequence
  Synthetic
gccaagcatttaggtgacactataggcaggtgctggtcaggtcacgtttcagagctatgctggaaacagc

SEQ ID NO: 54849 - DNA, 70 bp, Artificial Sequence
  Synthetic
gccaagcatttaggtgacactataggttaagcaacttgcccaaaggtttcagagctatgctggaaacagc

SEQ ID NO: 54850 - DNA, 70 bp, Artificial Sequence
  Synthetic
gccaagcatttaggtgacactatagttgctagataacttcctgctgtttcagagctatgctggaaacagc

SEQ ID NO: 54851 - DNA, 70 bp, Artificial Sequence
  Synthetic
gccaagcatttaggtgacactataggcttttgtttggagagatgcgtttcagagctatgctggaaacagc

SEQ ID NO: 54852 - DNA, 70 bp, Artificial Sequence
  Synthetic
gccaagcatttaggtgacactatagaagaagctgccaggcataatgtttcagagctatgctggaaacagc

SEQ ID NO: 54853 - DNA, 70 bp, Artificial Sequence
  Synthetic
gccaagcatttaggtgacactatagtctgagtttcatagtgattggtttcagagctatgctggaaacagc

SEQ ID NO: 54854 - DNA, 70 bp, Artificial Sequence
  Synthetic
gccaagcatttaggtgacactatagtgacacttaaaagaggatgagtttcagagctatgctggaaacagc

SEQ ID NO: 54855 - DNA, 70 bp, Artificial Sequence
  Synthetic
gccaagcatttaggtgacactatagggcggtgggggtggctatgggtttcagagctatgctggaaacagc

SEQ ID NO: 54856 - DNA, 70 bp, Artificial Sequence
  Synthetic
gccaagcatttaggtgacactatagtccagcagcagcagtagctagtttcagagctatgctggaaacagc

SEQ ID NO: 54857 - DNA, 70 bp, Artificial Sequence
  Synthetic
gccaagcatttaggtgacactatagaataggaagaagctcagtatgtttcagagctatgctggaaacagc

SEQ ID NO: 54858 - DNA, 70 bp, Artificial Sequence
  Synthetic
gccaagcatttaggtgacactataggtggtggatatggtagcagagtttcagagctatgctggaaacagc

SEQ ID NO: 54859 - DNA, 70 bp, Artificial Sequence
  Synthetic
gccaagcatttaggtgacactatagaactacaagccatactgagggtttcagagctatgctggaaacagc

SEQ ID NO: 54860 - DNA, 70 bp, Artificial Sequence
  Synthetic
gccaagcatttaggtgacactatagcagagacagcgccaatggcggtttcagagctatgctggaaacagc

SEQ ID NO: 54861 - DNA, 70 bp, Artificial Sequence
  Synthetic
gccaagcatttaggtgacactatagtatgtgcttaagagtcatccgtttcagagctatgctggaaacagc

SEQ ID NO: 54862 - DNA, 70 bp, Artificial Sequence
  Synthetic
gccaagcatttaggtgacactataggggaaggtatccaggcgagggtttcagagctatgctggaaacagc

SEQ ID NO: 54863 - DNA, 70 bp, Artificial Sequence
  Synthetic
gccaagcatttaggtgacactatagacaattaccagccatactaagtttcagagctatgctggaaacagc

SEQ ID NO: 54864 - DNA, 70 bp, Artificial Sequence
  Synthetic
gccaagcatttaggtgacactatagagtgggcagaacagcatggggtttcagagctatgctggaaacagc

SEQ ID NO: 54865 - DNA, 70 bp, Artificial Sequence
  Synthetic
gccaagcatttaggtgacactatagtggagttttcctgtaaaactgtttcagagctatgctggaaacagc

SEQ ID NO: 54866 - DNA, 70 bp, Artificial Sequence
  Synthetic
gccaagcatttaggtgacactataggctccttctctacctaagcagtttcagagctatgctggaaacagc

SEQ ID NO: 54867 - DNA, 70 bp, Artificial Sequence
  Synthetic
gccaagcatttaggtgacactatagtgagtggaggtggatggcgtgtttcagagctatgctggaaacagc

SEQ ID NO: 54868 - DNA, 70 bp, Artificial Sequence
  Synthetic
gccaagcatttaggtgacactatagaatactgtgcattctgtatcgtttcagagctatgctggaaacagc

SEQ ID NO: 54869 - DNA, 70 bp, Artificial Sequence
  Synthetic
gccaagcatttaggtgacactatagaagcagtatgcagatgttgagtttcagagctatgctggaaacagc

SEQ ID NO: 54870 - DNA, 70 bp, Artificial Sequence
  Synthetic
gccaagcatttaggtgacactataggctcagcacgcctcctaattgtttcagagctatgctggaaacagc

SEQ ID NO: 54871 - DNA, 70 bp, Artificial Sequence
  Synthetic
gccaagcatttaggtgacactatagaagcttcaatgtatagggatgtttcagagctatgctggaaacagc

SEQ ID NO: 54872 - DNA, 70 bp, Artificial Sequence
  Synthetic
gccaagcatttaggtgacactatagcaattcgaacgtcaatctctgtttcagagctatgctggaaacagc

SEQ ID NO: 54873 - DNA, 70 bp, Artificial Sequence
  Synthetic
gccaagcatttaggtgacactatagaggatacttatgggcaacaggtttcagagctatgctggaaacagc

SEQ ID NO: 54874 - DNA, 70 bp, Artificial Sequence
  Synthetic
gccaagcatttaggtgacactatagtggagtcagcattatcaccagtttcagagctatgctggaaacagc

SEQ ID NO: 54875 - DNA, 70 bp, Artificial Sequence
  Synthetic
gccaagcatttaggtgacactatagtactccgggaacacacaggggtttcagagctatgctggaaacagc

SEQ ID NO: 54876 - DNA, 70 bp, Artificial Sequence
  Synthetic
gccaagcatttaggtgacactatagactacgggtaccaagggtatgtttcagagctatgctggaaacagc

SEQ ID NO: 54877 - DNA, 70 bp, Artificial Sequence
  Synthetic
gccaagcatttaggtgacactatagccagcaacggctggctctgagtttcagagctatgctggaaacagc

SEQ ID NO: 54878 - DNA, 70 bp, Artificial Sequence
  Synthetic
gccaagcatttaggtgacactatagaagctactagaatgcagctagtttcagagctatgctggaaacagc

SEQ ID NO: 54879 - DNA, 70 bp, Artificial Sequence
  Synthetic
gccaagcatttaggtgacactatagatgcattgccattttcacatgtttcagagctatgctggaaacagc

SEQ ID NO: 54880 - DNA, 70 bp, Artificial Sequence
  Synthetic
gccaagcatttaggtgacactatagaagctgggcaccgataactagtttcagagctatgctggaaacagc

SEQ ID NO: 54881 - DNA, 70 bp, Artificial Sequence
  Synthetic
gccaagcatttaggtgacactataggctgaggctgcgccctgagcgtttcagagctatgctggaaacagc

SEQ ID NO: 54882 - DNA, 70 bp, Artificial Sequence
  Synthetic
gccaagcatttaggtgacactataggtgatcatacaagactgagtgtttcagagctatgctggaaacagc

SEQ ID NO: 54883 - DNA, 70 bp, Artificial Sequence
  Synthetic
gccaagcatttaggtgacactatagagagagatttcttctggtgtgtttcagagctatgctggaaacagc

SEQ ID NO: 54884 - DNA, 70 bp, Artificial Sequence
  Synthetic
gccaagcatttaggtgacactatagggtctgtcagtgcttgtcaggtttcagagctatgctggaaacagc

SEQ ID NO: 54885 - DNA, 70 bp, Artificial Sequence
  Synthetic
gccaagcatttaggtgacactatagacaacttctctaccttgctggtttcagagctatgctggaaacagc

SEQ ID NO: 54886 - DNA, 70 bp, Artificial Sequence
  Synthetic
gccaagcatttaggtgacactatagaagtaatcgaaagccaagcagtttcagagctatgctggaaacagc

SEQ ID NO: 54887 - DNA, 70 bp, Artificial Sequence
  Synthetic
gccaagcatttaggtgacactatagtgcagatccgtcacagactagtttcagagctatgctggaaacagc

SEQ ID NO: 54888 - DNA, 70 bp, Artificial Sequence
  Synthetic
gccaagcatttaggtgacactataggtcaagagtcagtgccaaaagtttcagagctatgctggaaacagc

SEQ ID NO: 54889 - DNA, 70 bp, Artificial Sequence
  Synthetic
gccaagcatttaggtgacactatagttagggatgaagaccttcacgtttcagagctatgctggaaacagc

SEQ ID NO: 54890 - DNA, 70 bp, Artificial Sequence
  Synthetic
gccaagcatttaggtgacactatagggagccggtgggcttctcaggtttcagagctatgctggaaacagc

SEQ ID NO: 54891 - DNA, 70 bp, Artificial Sequence
  Synthetic
gccaagcatttaggtgacactatagctgactacctcccactgagggtttcagagctatgctggaaacagc

SEQ ID NO: 54892 - DNA, 70 bp, Artificial Sequence
  Synthetic
gccaagcatttaggtgacactatagctccagcgcagacttttgacgtttcagagctatgctggaaacagc

SEQ ID NO: 54893 - DNA, 70 bp, Artificial Sequence
  Synthetic
gccaagcatttaggtgacactatagtaaagttggctgtgagctccgtttcagagctatgctggaaacagc

SEQ ID NO: 54894 - DNA, 70 bp, Artificial Sequence
  Synthetic
gccaagcatttaggtgacactatagtccagccgctggagtcttaggtttcagagctatgctggaaacagc

SEQ ID NO: 54895 - DNA, 70 bp, Artificial Sequence
  Synthetic
gccaagcatttaggtgacactatagaatctggttccagaacaggagtttcagagctatgctggaaacagc

SEQ ID NO: 54896 - DNA, 70 bp, Artificial Sequence
  Synthetic
gccaagcatttaggtgacactatagcagatgctgcaagtcgattggtttcagagctatgctggaaacagc

SEQ ID NO: 54897 - DNA, 70 bp, Artificial Sequence
  Synthetic
gccaagcatttaggtgacactatagagccccaagcccactatcacgtttcagagctatgctggaaacagc

SEQ ID NO: 54898 - DNA, 70 bp, Artificial Sequence
  Synthetic
gccaagcatttaggtgacactatagtctagaagattatatggagggtttcagagctatgctggaaacagc

SEQ ID NO: 54899 - DNA, 70 bp, Artificial Sequence
  Synthetic
gccaagcatttaggtgacactatagaacgctcagatactcagggagtttcagagctatgctggaaacagc

SEQ ID NO: 54900 - DNA, 70 bp, Artificial Sequence
  Synthetic
gccaagcatttaggtgacactataggaggactcagaggcaaaggcgtttcagagctatgctggaaacagc

SEQ ID NO: 54901 - DNA, 70 bp, Artificial Sequence
  Synthetic
gccaagcatttaggtgacactatagggaagacgaggaggaatgaggtttcagagctatgctggaaacagc

SEQ ID NO: 54902 - DNA, 70 bp, Artificial Sequence
  Synthetic
gccaagcatttaggtgacactatagggcatcactcgtcttttgctgtttcagagctatgctggaaacagc

SEQ ID NO: 54903 - DNA, 70 bp, Artificial Sequence
  Synthetic
gccaagcatttaggtgacactataggtggctaggttcagttcagggtttcagagctatgctggaaacagc

SEQ ID NO: 54904 - DNA, 70 bp, Artificial Sequence
  Synthetic
gccaagcatttaggtgacactatagcaggcaaggagatctcttaagtttcagagctatgctggaaacagc

SEQ ID NO: 54905 - DNA, 70 bp, Artificial Sequence
  Synthetic
gccaagcatttaggtgacactatagaaacaggttagggaaactgcgtttcagagctatgctggaaacagc

SEQ ID NO: 54906 - DNA, 70 bp, Artificial Sequence
  Synthetic
gccaagcatttaggtgacactatagcgttcgccctttcccatcacgtttcagagctatgctggaaacagc

SEQ ID NO: 54907 - DNA, 70 bp, Artificial Sequence
  Synthetic
gccaagcatttaggtgacactatagtcgtatataaagtgtggggggtttcagagctatgctggaaacagc

SEQ ID NO: 54908 - DNA, 70 bp, Artificial Sequence
  Synthetic
gccaagcatttaggtgacactatagcctctgggcgggctcagggcgtttcagagctatgctggaaacagc

SEQ ID NO: 54909 - DNA, 70 bp, Artificial Sequence
  Synthetic
gccaagcatttaggtgacactatagccctttccagcaccttcactgtttcagagctatgctggaaacagc

SEQ ID NO: 54910 - DNA, 70 bp, Artificial Sequence
  Synthetic
gccaagcatttaggtgacactatagaggaggaagaggaagagtgagtttcagagctatgctggaaacagc

SEQ ID NO: 54911 - DNA, 70 bp, Artificial Sequence
  Synthetic
gccaagcatttaggtgacactataggcagaagggcgacaagaagtgtttcagagctatgctggaaacagc

SEQ ID NO: 54912 - DNA, 70 bp, Artificial Sequence
  Synthetic
gccaagcatttaggtgacactatagttttcttcattttcatccgcgtttcagagctatgctggaaacagc

SEQ ID NO: 54913 - DNA, 70 bp, Artificial Sequence
  Synthetic
gccaagcatttaggtgacactatagtaaaattggaggtcagttccgtttcagagctatgctggaaacagc

SEQ ID NO: 54914 - DNA, 70 bp, Artificial Sequence
  Synthetic
gccaagcatttaggtgacactatagcggtctgcaggttacagcaggtttcagagctatgctggaaacagc

SEQ ID NO: 54915 - DNA, 70 bp, Artificial Sequence
  Synthetic
gccaagcatttaggtgacactatagcaagctctctccttcttttagtttcagagctatgctggaaacagc

SEQ ID NO: 54916 - DNA, 70 bp, Artificial Sequence
  Synthetic
gccaagcatttaggtgacactataggcagcgggtgggtggtcagggtttcagagctatgctggaaacagc

SEQ ID NO: 54917 - DNA, 70 bp, Artificial Sequence
  Synthetic
gccaagcatttaggtgacactatagaacgggcagaggacattaccgtttcagagctatgctggaaacagc

SEQ ID NO: 54918 - DNA, 70 bp, Artificial Sequence
  Synthetic
gccaagcatttaggtgacactatagaaagcaaagaggctctttaggtttcagagctatgctggaaacagc

SEQ ID NO: 54919 - DNA, 70 bp, Artificial Sequence
  Synthetic
gccaagcatttaggtgacactataggagaagcagaaagagtgaccgtttcagagctatgctggaaacagc

SEQ ID NO: 54920 - DNA, 70 bp, Artificial Sequence
  Synthetic
gccaagcatttaggtgacactatagggaggaaaaggaagaaaacagtttcagagctatgctggaaacagc

SEQ ID NO: 54921 - DNA, 70 bp, Artificial Sequence
  Synthetic
gccaagcatttaggtgacactatagggtttaggactgctccttgtgtttcagagctatgctggaaacagc

SEQ ID NO: 54922 - DNA, 70 bp, Artificial Sequence
  Synthetic
gccaagcatttaggtgacactatagcccaagtaccggcctcacgagtttcagagctatgctggaaacagc

SEQ ID NO: 54923 - DNA, 70 bp, Artificial Sequence
  Synthetic
gccaagcatttaggtgacactatagcgccaacctcacgttttcttgtttcagagctatgctggaaacagc

SEQ ID NO: 54924 - DNA, 70 bp, Artificial Sequence
  Synthetic
gccaagcatttaggtgacactatagttcctggagctctcaaaatagtttcagagctatgctggaaacagc

SEQ ID NO: 54925 - DNA, 70 bp, Artificial Sequence
  Synthetic
gccaagcatttaggtgacactatagggtgcttcgggagcaggcgcgtttcagagctatgctggaaacagc

SEQ ID NO: 54926 - DNA, 70 bp, Artificial Sequence
  Synthetic
gccaagcatttaggtgacactatagaaagatactgtctcctgatggtttcagagctatgctggaaacagc

SEQ ID NO: 54927 - DNA, 70 bp, Artificial Sequence
  Synthetic
gccaagcatttaggtgacactatagccaaactgacgcatctgtaggtttcagagctatgctggaaacagc

SEQ ID NO: 54928 - DNA, 70 bp, Artificial Sequence
  Synthetic
gccaagcatttaggtgacactatagccagggtccccacttctatagtttcagagctatgctggaaacagc

SEQ ID NO: 54929 - DNA, 70 bp, Artificial Sequence
  Synthetic
gccaagcatttaggtgacactatagaagttaatttgtcaggccttgtttcagagctatgctggaaacagc

SEQ ID NO: 54930 - DNA, 70 bp, Artificial Sequence
  Synthetic
gccaagcatttaggtgacactatagtgccccaaaggagactgaccgtttcagagctatgctggaaacagc

SEQ ID NO: 54931 - DNA, 70 bp, Artificial Sequence
  Synthetic
gccaagcatttaggtgacactatagcttgcattagttctcagctagtttcagagctatgctggaaacagc

SEQ ID NO: 54932 - DNA, 70 bp, Artificial Sequence
  Synthetic
gccaagcatttaggtgacactatagcactctgaaagacttcttcagtttcagagctatgctggaaacagc

SEQ ID NO: 54933 - DNA, 70 bp, Artificial Sequence
  Synthetic
gccaagcatttaggtgacactatagcagcgcctcccagttctgaggtttcagagctatgctggaaacagc

SEQ ID NO: 54934 - DNA, 70 bp, Artificial Sequence
  Synthetic
gccaagcatttaggtgacactataggccgctcgctcagaactgacgtttcagagctatgctggaaacagc

SEQ ID NO: 54935 - DNA, 70 bp, Artificial Sequence
  Synthetic
gccaagcatttaggtgacactatagacactgcagcagcaacacaagtttcagagctatgctggaaacagc

SEQ ID NO: 54936 - DNA, 70 bp, Artificial Sequence
  Synthetic
gccaagcatttaggtgacactatagggtgggcggggcttacatgcgtttcagagctatgctggaaacagc

SEQ ID NO: 54937 - DNA, 70 bp, Artificial Sequence
  Synthetic
gccaagcatttaggtgacactataggccaggagccaggaagcctagtttcagagctatgctggaaacagc

SEQ ID NO: 54938 - DNA, 70 bp, Artificial Sequence
  Synthetic
gccaagcatttaggtgacactatagaccttactcatgcagcaagtgtttcagagctatgctggaaacagc

SEQ ID NO: 54939 - DNA, 70 bp, Artificial Sequence
  Synthetic
gccaagcatttaggtgacactatagatcaatccattggcaatcaagtttcagagctatgctggaaacagc

SEQ ID NO: 54940 - DNA, 70 bp, Artificial Sequence
  Synthetic
gccaagcatttaggtgacactatagaacatggatcagctagagttgtttcagagctatgctggaaacagc

SEQ ID NO: 54941 - DNA, 70 bp, Artificial Sequence
  Synthetic
gccaagcatttaggtgacactatagcatggtgacccagctctgacgtttcagagctatgctggaaacagc

SEQ ID NO: 54942 - DNA, 70 bp, Artificial Sequence
  Synthetic
gccaagcatttaggtgacactatagattccagacaagtttgttgtgtttcagagctatgctggaaacagc

SEQ ID NO: 54943 - DNA, 70 bp, Artificial Sequence
  Synthetic
gccaagcatttaggtgacactataggaggaccggaggaaagcagggtttcagagctatgctggaaacagc

SEQ ID NO: 54944 - DNA, 70 bp, Artificial Sequence
  Synthetic
gccaagcatttaggtgacactatagcggccaccttggcctagagcgtttcagagctatgctggaaacagc

SEQ ID NO: 54945 - DNA, 70 bp, Artificial Sequence
  Synthetic
gccaagcatttaggtgacactatagggtacctgcactcaagccttgtttcagagctatgctggaaacagc

SEQ ID NO: 54946 - DNA, 70 bp, Artificial Sequence
  Synthetic
gccaagcatttaggtgacactatagcgactgcaatagagaagatagtttcagagctatgctggaaacagc

SEQ ID NO: 54947 - DNA, 70 bp, Artificial Sequence
  Synthetic
gccaagcatttaggtgacactatagaaaggcagagcttcctttgcgtttcagagctatgctggaaacagc

SEQ ID NO: 54948 - DNA, 70 bp, Artificial Sequence
  Synthetic
gccaagcatttaggtgacactataggcagaagctgctgaagcacggtttcagagctatgctggaaacagc

SEQ ID NO: 54949 - DNA, 70 bp, Artificial Sequence
  Synthetic
gccaagcatttaggtgacactatagggaaaacagcagcttctaaggtttcagagctatgctggaaacagc

SEQ ID NO: 54950 - DNA, 70 bp, Artificial Sequence
  Synthetic
gccaagcatttaggtgacactatagctggtcccagcaggcctagtgtttcagagctatgctggaaacagc

SEQ ID NO: 54951 - DNA, 70 bp, Artificial Sequence
  Synthetic
gccaagcatttaggtgacactataggatgcctgaagggtagtcatgtttcagagctatgctggaaacagc

SEQ ID NO: 54952 - DNA, 70 bp, Artificial Sequence
  Synthetic
gccaagcatttaggtgacactatagtcagatgcaagcagcaacttgtttcagagctatgctggaaacagc

SEQ ID NO: 54953 - DNA, 70 bp, Artificial Sequence
  Synthetic
gccaagcatttaggtgacactatagcccaaagatgtcaatactgtgtttcagagctatgctggaaacagc

SEQ ID NO: 54954 - DNA, 70 bp, Artificial Sequence
  Synthetic
gccaagcatttaggtgacactatagtgagtgtgaggatagcttatgtttcagagctatgctggaaacagc

SEQ ID NO: 54955 - DNA, 70 bp, Artificial Sequence
  Synthetic
gccaagcatttaggtgacactatagcctgggctgcactcactgaggtttcagagctatgctggaaacagc

SEQ ID NO: 54956 - DNA, 70 bp, Artificial Sequence
  Synthetic
gccaagcatttaggtgacactatagattacaggaggccaaatagagtttcagagctatgctggaaacagc

SEQ ID NO: 54957 - DNA, 70 bp, Artificial Sequence
  Synthetic
gccaagcatttaggtgacactatagacacttgcagctcatgcagcgtttcagagctatgctggaaacagc

SEQ ID NO: 54958 - DNA, 70 bp, Artificial Sequence
  Synthetic
gccaagcatttaggtgacactatagcgaggggccgctgggtcacagtttcagagctatgctggaaacagc

SEQ ID NO: 54959 - DNA, 70 bp, Artificial Sequence
  Synthetic
gccaagcatttaggtgacactatagttcctgggcttgtttccaaagtttcagagctatgctggaaacagc

SEQ ID NO: 54960 - DNA, 70 bp, Artificial Sequence
  Synthetic
gccaagcatttaggtgacactatagtggccagaagcaagcgggaagtttcagagctatgctggaaacagc

SEQ ID NO: 54961 - DNA, 70 bp, Artificial Sequence
  Synthetic
gccaagcatttaggtgacactatagagcagttatttcagctgtaggtttcagagctatgctggaaacagc

SEQ ID NO: 54962 - DNA, 70 bp, Artificial Sequence
  Synthetic
gccaagcatttaggtgacactatagccaaaccaataactgcctgagtttcagagctatgctggaaacagc

SEQ ID NO: 54963 - DNA, 70 bp, Artificial Sequence
  Synthetic
gccaagcatttaggtgacactataggagcgactgggtcagggttcgtttcagagctatgctggaaacagc

SEQ ID NO: 54964 - DNA, 70 bp, Artificial Sequence
  Synthetic
gccaagcatttaggtgacactatagcatccccgccacgctcgctggtttcagagctatgctggaaacagc

SEQ ID NO: 54965 - DNA, 70 bp, Artificial Sequence
  Synthetic
gccaagcatttaggtgacactataggtccagggaagttcaagagtgtttcagagctatgctggaaacagc

SEQ ID NO: 54966 - DNA, 70 bp, Artificial Sequence
  Synthetic
gccaagcatttaggtgacactatagttctgcatattcgctcctaagtttcagagctatgctggaaacagc

SEQ ID NO: 54967 - DNA, 70 bp, Artificial Sequence
  Synthetic
gccaagcatttaggtgacactatagctagggctattacctgtctggtttcagagctatgctggaaacagc

SEQ ID NO: 54968 - DNA, 70 bp, Artificial Sequence
  Synthetic
gccaagcatttaggtgacactatagtccaattcccaccacatgccgtttcagagctatgctggaaacagc

SEQ ID NO: 54969 - DNA, 70 bp, Artificial Sequence
  Synthetic
gccaagcatttaggtgacactatagggagcactgctggaagtgaggtttcagagctatgctggaaacagc

SEQ ID NO: 54970 - DNA, 70 bp, Artificial Sequence
  Synthetic
gccaagcatttaggtgacactatagctctaccatcacaacacagtgtttcagagctatgctggaaacagc

SEQ ID NO: 54971 - DNA, 70 bp, Artificial Sequence
  Synthetic
gccaagcatttaggtgacactatagccaggagttcaaaaccactcgtttcagagctatgctggaaacagc

SEQ ID NO: 54972 - DNA, 70 bp, Artificial Sequence
  Synthetic
gccaagcatttaggtgacactatagatgaatatgtccaagagcaggtttcagagctatgctggaaacagc

SEQ ID NO: 54973 - DNA, 70 bp, Artificial Sequence
  Synthetic
gccaagcatttaggtgacactatagcagcatggaagggtcagaaggtttcagagctatgctggaaacagc

SEQ ID NO: 54974 - DNA, 70 bp, Artificial Sequence
  Synthetic
gccaagcatttaggtgacactatagccttatactcagttcgacttgtttcagagctatgctggaaacagc

SEQ ID NO: 54975 - DNA, 70 bp, Artificial Sequence
  Synthetic
gccaagcatttaggtgacactatagatagctccgaatgctggtaggtttcagagctatgctggaaacagc

SEQ ID NO: 54976 - DNA, 70 bp, Artificial Sequence
  Synthetic
gccaagcatttaggtgacactatagttgttggcagaacatttgacgtttcagagctatgctggaaacagc

SEQ ID NO: 54977 - DNA, 70 bp, Artificial Sequence
  Synthetic
gccaagcatttaggtgacactatagcgttgggcaggacttcaggtgtttcagagctatgctggaaacagc

SEQ ID NO: 54978 - DNA, 70 bp, Artificial Sequence
  Synthetic
gccaagcatttaggtgacactataggggcacgactttggctgggagtttcagagctatgctggaaacagc

SEQ ID NO: 54979 - DNA, 70 bp, Artificial Sequence
  Synthetic
gccaagcatttaggtgacactataggaccgggcacgactttggctgtttcagagctatgctggaaacagc

SEQ ID NO: 54980 - DNA, 70 bp, Artificial Sequence
  Synthetic
gccaagcatttaggtgacactatagcaggaagagggtgataaatggtttcagagctatgctggaaacagc

SEQ ID NO: 54981 - DNA, 70 bp, Artificial Sequence
  Synthetic
gccaagcatttaggtgacactatagtcactgggaggacattgaacgtttcagagctatgctggaaacagc

SEQ ID NO: 54982 - DNA, 70 bp, Artificial Sequence
  Synthetic
gccaagcatttaggtgacactatagggacttcggctggggctgaggtttcagagctatgctggaaacagc

SEQ ID NO: 54983 - DNA, 70 bp, Artificial Sequence
  Synthetic
gccaagcatttaggtgacactatagacatcattgagaagtggtaggtttcagagctatgctggaaacagc

SEQ ID NO: 54984 - DNA, 70 bp, Artificial Sequence
  Synthetic
gccaagcatttaggtgacactatagtgtagagaaatggcgttaaagtttcagagctatgctggaaacagc

SEQ ID NO: 54985 - DNA, 70 bp, Artificial Sequence
  Synthetic
gccaagcatttaggtgacactatagacaacagccaggtggtgagagtttcagagctatgctggaaacagc

SEQ ID NO: 54986 - DNA, 70 bp, Artificial Sequence
  Synthetic
gccaagcatttaggtgacactatagctgccacgcaaaagagttgagtttcagagctatgctggaaacagc

SEQ ID NO: 54987 - DNA, 70 bp, Artificial Sequence
  Synthetic
gccaagcatttaggtgacactatagaaggacttaatggtgcaagcgtttcagagctatgctggaaacagc

SEQ ID NO: 54988 - DNA, 70 bp, Artificial Sequence
  Synthetic
gccaagcatttaggtgacactatagagatgactttgaagaagccagtttcagagctatgctggaaacagc

SEQ ID NO: 54989 - DNA, 70 bp, Artificial Sequence
  Synthetic
gccaagcatttaggtgacactatagctcctggcccccctgagcaggtttcagagctatgctggaaacagc

SEQ ID NO: 54990 - DNA, 70 bp, Artificial Sequence
  Synthetic
gccaagcatttaggtgacactatagtcgttgagtagagaaattccgtttcagagctatgctggaaacagc

SEQ ID NO: 54991 - DNA, 70 bp, Artificial Sequence
  Synthetic
gccaagcatttaggtgacactatagtcacagagacacccctgagagtttcagagctatgctggaaacagc

SEQ ID NO: 54992 - DNA, 70 bp, Artificial Sequence
  Synthetic
gccaagcatttaggtgacactatagagcagtcacgtcatcaatcagtttcagagctatgctggaaacagc

SEQ ID NO: 54993 - DNA, 70 bp, Artificial Sequence
  Synthetic
gccaagcatttaggtgacactatagccccggtgctcaggctgccggtttcagagctatgctggaaacagc

SEQ ID NO: 54994 - DNA, 70 bp, Artificial Sequence
  Synthetic
gccaagcatttaggtgacactataggcccttccccagcagtggctgtttcagagctatgctggaaacagc

SEQ ID NO: 54995 - DNA, 70 bp, Artificial Sequence
  Synthetic
gccaagcatttaggtgacactatagctccggccgccccgcagtaagtttcagagctatgctggaaacagc

SEQ ID NO: 54996 - DNA, 70 bp, Artificial Sequence
  Synthetic
gccaagcatttaggtgacactatagcattcgtatgcagccttgaagtttcagagctatgctggaaacagc

SEQ ID NO: 54997 - DNA, 70 bp, Artificial Sequence
  Synthetic
gccaagcatttaggtgacactataggatccttcctgagcgtttccgtttcagagctatgctggaaacagc

SEQ ID NO: 54998 - DNA, 70 bp, Artificial Sequence
  Synthetic
gccaagcatttaggtgacactatagtaatctcaaacctgccttctgtttcagagctatgctggaaacagc

SEQ ID NO: 54999 - DNA, 70 bp, Artificial Sequence
  Synthetic
gccaagcatttaggtgacactatagattcaatttgaagcagtggtgtttcagagctatgctggaaacagc

SEQ ID NO: 55000 - DNA, 70 bp, Artificial Sequence
  Synthetic
gccaagcatttaggtgacactatagagaaatgagagaaatcaggagtttcagagctatgctggaaacagc

SEQ ID NO: 55001 - DNA, 70 bp, Artificial Sequence
  Synthetic
gccaagcatttaggtgacactataggagggcttccattgcctagggtttcagagctatgctggaaacagc

SEQ ID NO: 55002 - DNA, 70 bp, Artificial Sequence
  Synthetic
gccaagcatttaggtgacactatagaacaccaaggtcaggtagccgtttcagagctatgctggaaacagc

SEQ ID NO: 55003 - DNA, 70 bp, Artificial Sequence
  Synthetic
gccaagcatttaggtgacactatagagactacgccaagctctgaagtttcagagctatgctggaaacagc

SEQ ID NO: 55004 - DNA, 70 bp, Artificial Sequence
  Synthetic
gccaagcatttaggtgacactatagccagttttctttagactgccgtttcagagctatgctggaaacagc

SEQ ID NO: 55005 - DNA, 70 bp, Artificial Sequence
  Synthetic
gccaagcatttaggtgacactatagtatcctggtaaagaagctgtgtttcagagctatgctggaaacagc

SEQ ID NO: 55006 - DNA, 70 bp, Artificial Sequence
  Synthetic
gccaagcatttaggtgacactatagcctccaaggaacttaagcaagtttcagagctatgctggaaacagc

SEQ ID NO: 55007 - DNA, 70 bp, Artificial Sequence
  Synthetic
gccaagcatttaggtgacactataggataatcaggccaggctcaggtttcagagctatgctggaaacagc

SEQ ID NO: 55008 - DNA, 70 bp, Artificial Sequence
  Synthetic
gccaagcatttaggtgacactataggggacctcagtggaagtcacgtttcagagctatgctggaaacagc

SEQ ID NO: 55009 - DNA, 70 bp, Artificial Sequence
  Synthetic
gccaagcatttaggtgacactatagatccttaaatcactgagtctgtttcagagctatgctggaaacagc

SEQ ID NO: 55010 - DNA, 70 bp, Artificial Sequence
  Synthetic
gccaagcatttaggtgacactataggagcagcgggcaaccctgatgtttcagagctatgctggaaacagc

SEQ ID NO: 55011 - DNA, 70 bp, Artificial Sequence
  Synthetic
gccaagcatttaggtgacactatagggccccagccccaccgtcacgtttcagagctatgctggaaacagc

SEQ ID NO: 55012 - DNA, 70 bp, Artificial Sequence
  Synthetic
gccaagcatttaggtgacactatagcatccagactcaggctgtgcgtttcagagctatgctggaaacagc

SEQ ID NO: 55013 - DNA, 70 bp, Artificial Sequence
  Synthetic
gccaagcatttaggtgacactatagagatgaatgccagactgtgagtttcagagctatgctggaaacagc

SEQ ID NO: 55014 - DNA, 70 bp, Artificial Sequence
  Synthetic
gccaagcatttaggtgacactatagaggaccccactgtctcctaggtttcagagctatgctggaaacagc

SEQ ID NO: 55015 - DNA, 70 bp, Artificial Sequence
  Synthetic
gccaagcatttaggtgacactatagagtggcatatcactatccaggtttcagagctatgctggaaacagc

SEQ ID NO: 55016 - DNA, 70 bp, Artificial Sequence
  Synthetic
gccaagcatttaggtgacactatagctttgactatgtgctgaaacgtttcagagctatgctggaaacagc

SEQ ID NO: 55017 - DNA, 70 bp, Artificial Sequence
  Synthetic
gccaagcatttaggtgacactatagcactctggagcataatgtgtgtttcagagctatgctggaaacagc

SEQ ID NO: 55018 - DNA, 70 bp, Artificial Sequence
  Synthetic
gccaagcatttaggtgacactatagtcagaggcgcggggtcttaggtttcagagctatgctggaaacagc

SEQ ID NO: 55019 - DNA, 70 bp, Artificial Sequence
  Synthetic
gccaagcatttaggtgacactataggcaggagcgctttccaaagggtttcagagctatgctggaaacagc

SEQ ID NO: 55020 - DNA, 70 bp, Artificial Sequence
  Synthetic
gccaagcatttaggtgacactatagcgcagaccagagcacatagagtttcagagctatgctggaaacagc

SEQ ID NO: 55021 - DNA, 70 bp, Artificial Sequence
  Synthetic
gccaagcatttaggtgacactataggacgatgaggaggagtaggagtttcagagctatgctggaaacagc

SEQ ID NO: 55022 - DNA, 70 bp, Artificial Sequence
  Synthetic
gccaagcatttaggtgacactatagtgagccctctgacgatgagggtttcagagctatgctggaaacagc

SEQ ID NO: 55023 - DNA, 70 bp, Artificial Sequence
  Synthetic
gccaagcatttaggtgacactatagttctttctcttctgacagaagtttcagagctatgctggaaacagc

SEQ ID NO: 55024 - DNA, 70 bp, Artificial Sequence
  Synthetic
gccaagcatttaggtgacactatagatggcagatcagttgtaattgtttcagagctatgctggaaacagc

SEQ ID NO: 55025 - DNA, 70 bp, Artificial Sequence
  Synthetic
gccaagcatttaggtgacactatagattctgttcatctctgctgagtttcagagctatgctggaaacagc

SEQ ID NO: 55026 - DNA, 70 bp, Artificial Sequence
  Synthetic
gccaagcatttaggtgacactatagcctgttctctagcagtacccgtttcagagctatgctggaaacagc

SEQ ID NO: 55027 - DNA, 70 bp, Artificial Sequence
  Synthetic
gccaagcatttaggtgacactatagagatgacgacacatcacgcagtttcagagctatgctggaaacagc

SEQ ID NO: 55028 - DNA, 70 bp, Artificial Sequence
  Synthetic
gccaagcatttaggtgacactatagtcgcatggaagaagtcgattgtttcagagctatgctggaaacagc

SEQ ID NO: 55029 - DNA, 70 bp, Artificial Sequence
  Synthetic
gccaagcatttaggtgacactatagtgaagaagaagaaacagcaagtttcagagctatgctggaaacagc

SEQ ID NO: 55030 - DNA, 70 bp, Artificial Sequence
  Synthetic
gccaagcatttaggtgacactatagcttcgaagagtgtcaaagttgtttcagagctatgctggaaacagc

SEQ ID NO: 55031 - DNA, 70 bp, Artificial Sequence
  Synthetic
gccaagcatttaggtgacactatagcgcgccggcgcgccctcagtgtttcagagctatgctggaaacagc

SEQ ID NO: 55032 - DNA, 70 bp, Artificial Sequence
  Synthetic
gccaagcatttaggtgacactatagctgcagaattcagttgaagtgtttcagagctatgctggaaacagc

SEQ ID NO: 55033 - DNA, 70 bp, Artificial Sequence
  Synthetic
gccaagcatttaggtgacactatagacatgcacagatcaagaaacgtttcagagctatgctggaaacagc

SEQ ID NO: 55034 - DNA, 70 bp, Artificial Sequence
  Synthetic
gccaagcatttaggtgacactatagtgtaattggttcctagctttgtttcagagctatgctggaaacagc

SEQ ID NO: 55035 - DNA, 70 bp, Artificial Sequence
  Synthetic
gccaagcatttaggtgacactatagccattgaggaggtagattaggtttcagagctatgctggaaacagc

SEQ ID NO: 55036 - DNA, 70 bp, Artificial Sequence
  Synthetic
gccaagcatttaggtgacactatagccattgaggaggtggattaggtttcagagctatgctggaaacagc

SEQ ID NO: 55037 - DNA, 70 bp, Artificial Sequence
  Synthetic
gccaagcatttaggtgacactatagttcttcaattgtggggcctggtttcagagctatgctggaaacagc

SEQ ID NO: 55038 - DNA, 70 bp, Artificial Sequence
  Synthetic
gccaagcatttaggtgacactataggggacccaccatcgaagaaggtttcagagctatgctggaaacagc

SEQ ID NO: 55039 - DNA, 70 bp, Artificial Sequence
  Synthetic
gccaagcatttaggtgacactatagagacaagaagcttcctgaaagtttcagagctatgctggaaacagc

SEQ ID NO: 55040 - DNA, 70 bp, Artificial Sequence
  Synthetic
gccaagcatttaggtgacactatagatcctctggagagatggaaggtttcagagctatgctggaaacagc

SEQ ID NO: 55041 - DNA, 70 bp, Artificial Sequence
  Synthetic
gccaagcatttaggtgacactatagccctcccccaactggtgaaggtttcagagctatgctggaaacagc

SEQ ID NO: 55042 - DNA, 70 bp, Artificial Sequence
  Synthetic
gccaagcatttaggtgacactatagcattgaggaggttgattgaagtttcagagctatgctggaaacagc

SEQ ID NO: 55043 - DNA, 70 bp, Artificial Sequence
  Synthetic
gccaagcatttaggtgacactatagctcagggcccaccattgaaggtttcagagctatgctggaaacagc

SEQ ID NO: 55044 - DNA, 70 bp, Artificial Sequence
  Synthetic
gccaagcatttaggtgacactatagacaaaaggaagatcaaaagggtttcagagctatgctggaaacagc

SEQ ID NO: 55045 - DNA, 70 bp, Artificial Sequence
  Synthetic
gccaagcatttaggtgacactatagatccgggctaaggctttactgtttcagagctatgctggaaacagc

SEQ ID NO: 55046 - DNA, 70 bp, Artificial Sequence
  Synthetic
gccaagcatttaggtgacactataggtgcatagcgtttctgcagagtttcagagctatgctggaaacagc

SEQ ID NO: 55047 - DNA, 70 bp, Artificial Sequence
  Synthetic
gccaagcatttaggtgacactatagtggcaatcagggctcaactagtttcagagctatgctggaaacagc

SEQ ID NO: 55048 - DNA, 70 bp, Artificial Sequence
  Synthetic
gccaagcatttaggtgacactatagcgatgtcacttagtcccaacgtttcagagctatgctggaaacagc

SEQ ID NO: 55049 - DNA, 70 bp, Artificial Sequence
  Synthetic
gccaagcatttaggtgacactatagccagccgcagccaagtaggagtttcagagctatgctggaaacagc

SEQ ID NO: 55050 - DNA, 70 bp, Artificial Sequence
  Synthetic
gccaagcatttaggtgacactatagctcagattttgatctccgtcgtttcagagctatgctggaaacagc

SEQ ID NO: 55051 - DNA, 70 bp, Artificial Sequence
  Synthetic
gccaagcatttaggtgacactatagagtactggcatctcaggtacgtttcagagctatgctggaaacagc

SEQ ID NO: 55052 - DNA, 70 bp, Artificial Sequence
  Synthetic
gccaagcatttaggtgacactatagacatcgcgtcgtttgtttacgtttcagagctatgctggaaacagc

SEQ ID NO: 55053 - DNA, 70 bp, Artificial Sequence
  Synthetic
gccaagcatttaggtgacactataggtggcacaacttttgatacagtttcagagctatgctggaaacagc

SEQ ID NO: 55054 - DNA, 70 bp, Artificial Sequence
  Synthetic
gccaagcatttaggtgacactatagcagcggacgacagcatggatgtttcagagctatgctggaaacagc

SEQ ID NO: 55055 - DNA, 70 bp, Artificial Sequence
  Synthetic
gccaagcatttaggtgacactatagatgggaggtggtatgggagggtttcagagctatgctggaaacagc

SEQ ID NO: 55056 - DNA, 70 bp, Artificial Sequence
  Synthetic
gccaagcatttaggtgacactataggttcttctcccagaatatgggtttcagagctatgctggaaacagc

SEQ ID NO: 55057 - DNA, 70 bp, Artificial Sequence
  Synthetic
gccaagcatttaggtgacactatagggggcaggcaggtgcctacggtttcagagctatgctggaaacagc

SEQ ID NO: 55058 - DNA, 70 bp, Artificial Sequence
  Synthetic
gccaagcatttaggtgacactataggctgaacctccacatcagaagtttcagagctatgctggaaacagc

SEQ ID NO: 55059 - DNA, 70 bp, Artificial Sequence
  Synthetic
gccaagcatttaggtgacactatagaaactggaaagaactccaaagtttcagagctatgctggaaacagc

SEQ ID NO: 55060 - DNA, 70 bp, Artificial Sequence
  Synthetic
gccaagcatttaggtgacactatagcatgacctggggaaagcgcagtttcagagctatgctggaaacagc

SEQ ID NO: 55061 - DNA, 70 bp, Artificial Sequence
  Synthetic
gccaagcatttaggtgacactatagtcacatttaagcattgcaacgtttcagagctatgctggaaacagc

SEQ ID NO: 55062 - DNA, 70 bp, Artificial Sequence
  Synthetic
gccaagcatttaggtgacactataggagaataaagctgctgccaggtttcagagctatgctggaaacagc

SEQ ID NO: 55063 - DNA, 70 bp, Artificial Sequence
  Synthetic
gccaagcatttaggtgacactatagtttccattttatggggactagtttcagagctatgctggaaacagc

SEQ ID NO: 55064 - DNA, 70 bp, Artificial Sequence
  Synthetic
gccaagcatttaggtgacactataggaaaagcatcattcacatcggtttcagagctatgctggaaacagc

SEQ ID NO: 55065 - DNA, 70 bp, Artificial Sequence
  Synthetic
gccaagcatttaggtgacactatagggctactcctccgtcatcacgtttcagagctatgctggaaacagc

SEQ ID NO: 55066 - DNA, 70 bp, Artificial Sequence
  Synthetic
gccaagcatttaggtgacactatagtgcttgtttaaagtcctcatgtttcagagctatgctggaaacagc

SEQ ID NO: 55067 - DNA, 70 bp, Artificial Sequence
  Synthetic
gccaagcatttaggtgacactatagcatcaccgaataagactagggtttcagagctatgctggaaacagc

SEQ ID NO: 55068 - DNA, 70 bp, Artificial Sequence
  Synthetic
gccaagcatttaggtgacactatagttacagtctaagtatgctctgtttcagagctatgctggaaacagc

SEQ ID NO: 55069 - DNA, 70 bp, Artificial Sequence
  Synthetic
gccaagcatttaggtgacactatagatcgacatcgcacaagctttgtttcagagctatgctggaaacagc

SEQ ID NO: 55070 - DNA, 70 bp, Artificial Sequence
  Synthetic
gccaagcatttaggtgacactatagaaaggtgagctgtgtgtgatgtttcagagctatgctggaaacagc

SEQ ID NO: 55071 - DNA, 70 bp, Artificial Sequence
  Synthetic
gccaagcatttaggtgacactatagcttctcctcactgaaaatgagtttcagagctatgctggaaacagc

SEQ ID NO: 55072 - DNA, 70 bp, Artificial Sequence
  Synthetic
gccaagcatttaggtgacactatagcctccagtgtggttagcgaagtttcagagctatgctggaaacagc

SEQ ID NO: 55073 - DNA, 70 bp, Artificial Sequence
  Synthetic
gccaagcatttaggtgacactatagatctggcagtacgcttgagtgtttcagagctatgctggaaacagc

SEQ ID NO: 55074 - DNA, 70 bp, Artificial Sequence
  Synthetic
gccaagcatttaggtgacactatagtccctctgggcactgtgggggtttcagagctatgctggaaacagc

SEQ ID NO: 55075 - DNA, 70 bp, Artificial Sequence
  Synthetic
gccaagcatttaggtgacactatagcattgtcctctggaacacctgtttcagagctatgctggaaacagc

SEQ ID NO: 55076 - DNA, 70 bp, Artificial Sequence
  Synthetic
gccaagcatttaggtgacactatagtgcctctggaacacctaggcgtttcagagctatgctggaaacagc

SEQ ID NO: 55077 - DNA, 70 bp, Artificial Sequence
  Synthetic
gccaagcatttaggtgacactatagtgctcagcccagtgacacttgtttcagagctatgctggaaacagc

SEQ ID NO: 55078 - DNA, 70 bp, Artificial Sequence
  Synthetic
gccaagcatttaggtgacactatagagaaagtcatgttttagggagtttcagagctatgctggaaacagc

SEQ ID NO: 55079 - DNA, 70 bp, Artificial Sequence
  Synthetic
gccaagcatttaggtgacactataggagcactttcagagttagacgtttcagagctatgctggaaacagc

SEQ ID NO: 55080 - DNA, 70 bp, Artificial Sequence
  Synthetic
gccaagcatttaggtgacactatagtacatgtgtggatccattaagtttcagagctatgctggaaacagc

SEQ ID NO: 55081 - DNA, 70 bp, Artificial Sequence
  Synthetic
gccaagcatttaggtgacactatagtcaatcagaagcatgattccgtttcagagctatgctggaaacagc

SEQ ID NO: 55082 - DNA, 70 bp, Artificial Sequence
  Synthetic
gccaagcatttaggtgacactatagtcttttctaggcaacactgagtttcagagctatgctggaaacagc

SEQ ID NO: 55083 - DNA, 70 bp, Artificial Sequence
  Synthetic
gccaagcatttaggtgacactatagggcatccccacgaactgaccgtttcagagctatgctggaaacagc

SEQ ID NO: 55084 - DNA, 70 bp, Artificial Sequence
  Synthetic
gccaagcatttaggtgacactatagaatctccagaccatcacaatgtttcagagctatgctggaaacagc

SEQ ID NO: 55085 - DNA, 70 bp, Artificial Sequence
  Synthetic
gccaagcatttaggtgacactatagagcacaaactcaggtctctcgtttcagagctatgctggaaacagc

SEQ ID NO: 55086 - DNA, 70 bp, Artificial Sequence
  Synthetic
gccaagcatttaggtgacactatagcagctcatgcctctgcctatgtttcagagctatgctggaaacagc

SEQ ID NO: 55087 - DNA, 70 bp, Artificial Sequence
  Synthetic
gccaagcatttaggtgacactatagtctattcattctgtgacctcgtttcagagctatgctggaaacagc

SEQ ID NO: 55088 - DNA, 70 bp, Artificial Sequence
  Synthetic
gccaagcatttaggtgacactatagacctgaggtggtcatgtgaggtttcagagctatgctggaaacagc

SEQ ID NO: 55089 - DNA, 70 bp, Artificial Sequence
  Synthetic
gccaagcatttaggtgacactatagctctcaatgaactgccagtggtttcagagctatgctggaaacagc

SEQ ID NO: 55090 - DNA, 70 bp, Artificial Sequence
  Synthetic
gccaagcatttaggtgacactatagttgtttcaggtatgactgtcgtttcagagctatgctggaaacagc

SEQ ID NO: 55091 - DNA, 70 bp, Artificial Sequence
  Synthetic
gccaagcatttaggtgacactatagctcccaccatggcgctcagcgtttcagagctatgctggaaacagc

SEQ ID NO: 55092 - DNA, 70 bp, Artificial Sequence
  Synthetic
gccaagcatttaggtgacactataggtcaagacccagtgctaactgtttcagagctatgctggaaacagc

SEQ ID NO: 55093 - DNA, 70 bp, Artificial Sequence
  Synthetic
gccaagcatttaggtgacactatagacagggtgctaggacagcgcgtttcagagctatgctggaaacagc

SEQ ID NO: 55094 - DNA, 70 bp, Artificial Sequence
  Synthetic
gccaagcatttaggtgacactatagaagctggctgaatttttacagtttcagagctatgctggaaacagc

SEQ ID NO: 55095 - DNA, 70 bp, Artificial Sequence
  Synthetic
gccaagcatttaggtgacactatagggctttgggctggcctaatagtttcagagctatgctggaaacagc

SEQ ID NO: 55096 - DNA, 70 bp, Artificial Sequence
  Synthetic
gccaagcatttaggtgacactatagttgcgacagcatggacttctgtttcagagctatgctggaaacagc

SEQ ID NO: 55097 - DNA, 70 bp, Artificial Sequence
  Synthetic
gccaagcatttaggtgacactataggcggaagagcatgtggtgatgtttcagagctatgctggaaacagc

SEQ ID NO: 55098 - DNA, 70 bp, Artificial Sequence
  Synthetic
gccaagcatttaggtgacactatagctaggcaggagacccctacagtttcagagctatgctggaaacagc

SEQ ID NO: 55099 - DNA, 70 bp, Artificial Sequence
  Synthetic
gccaagcatttaggtgacactatagtggctttatactgcttctttgtttcagagctatgctggaaacagc

SEQ ID NO: 55100 - DNA, 70 bp, Artificial Sequence
  Synthetic
gccaagcatttaggtgacactatagcaaagtgtcattagtgaaccgtttcagagctatgctggaaacagc

SEQ ID NO: 55101 - DNA, 70 bp, Artificial Sequence
  Synthetic
gccaagcatttaggtgacactataggtaaccctggttaccactaagtttcagagctatgctggaaacagc

SEQ ID NO: 55102 - DNA, 70 bp, Artificial Sequence
  Synthetic
gccaagcatttaggtgacactatagtctgctactcccagggtaaggtttcagagctatgctggaaacagc

SEQ ID NO: 55103 - DNA, 70 bp, Artificial Sequence
  Synthetic
gccaagcatttaggtgacactatagttgggggcacattttaggtagtttcagagctatgctggaaacagc

SEQ ID NO: 55104 - DNA, 70 bp, Artificial Sequence
  Synthetic
gccaagcatttaggtgacactataggaaggctacaaaggcttcgtgtttcagagctatgctggaaacagc

SEQ ID NO: 55105 - DNA, 70 bp, Artificial Sequence
  Synthetic
gccaagcatttaggtgacactatagggtggtgtgcgggccctcacgtttcagagctatgctggaaacagc

SEQ ID NO: 55106 - DNA, 70 bp, Artificial Sequence
  Synthetic
gccaagcatttaggtgacactatagacatggagatctcagtcacagtttcagagctatgctggaaacagc

SEQ ID NO: 55107 - DNA, 70 bp, Artificial Sequence
  Synthetic
gccaagcatttaggtgacactatagtgtcattcatctgttcaagggtttcagagctatgctggaaacagc

SEQ ID NO: 55108 - DNA, 70 bp, Artificial Sequence
  Synthetic
gccaagcatttaggtgacactatagttaagaaggagaaagagggagtttcagagctatgctggaaacagc

SEQ ID NO: 55109 - DNA, 70 bp, Artificial Sequence
  Synthetic
gccaagcatttaggtgacactatagtatagttcgtcgttcttcaagtttcagagctatgctggaaacagc

SEQ ID NO: 55110 - DNA, 70 bp, Artificial Sequence
  Synthetic
gccaagcatttaggtgacactatagttgagaaagcacgcatcagtgtttcagagctatgctggaaacagc

SEQ ID NO: 55111 - DNA, 70 bp, Artificial Sequence
  Synthetic
gccaagcatttaggtgacactatagcagtcttcagtcattcttccgtttcagagctatgctggaaacagc

SEQ ID NO: 55112 - DNA, 70 bp, Artificial Sequence
  Synthetic
gccaagcatttaggtgacactatagggtctcctgtgattggctaagtttcagagctatgctggaaacagc

SEQ ID NO: 55113 - DNA, 70 bp, Artificial Sequence
  Synthetic
gccaagcatttaggtgacactatagagagttacattgtcctctaagtttcagagctatgctggaaacagc

SEQ ID NO: 55114 - DNA, 70 bp, Artificial Sequence
  Synthetic
gccaagcatttaggtgacactatagtgctagaagtctgctgttgtgtttcagagctatgctggaaacagc

SEQ ID NO: 55115 - DNA, 70 bp, Artificial Sequence
  Synthetic
gccaagcatttaggtgacactatagcgatgtgcagaagttgtcaggtttcagagctatgctggaaacagc

SEQ ID NO: 55116 - DNA, 70 bp, Artificial Sequence
  Synthetic
gccaagcatttaggtgacactatagagccaaggcttcggactactgtttcagagctatgctggaaacagc

SEQ ID NO: 55117 - DNA, 70 bp, Artificial Sequence
  Synthetic
gccaagcatttaggtgacactatagatcccaggctggagcttcacgtttcagagctatgctggaaacagc

SEQ ID NO: 55118 - DNA, 70 bp, Artificial Sequence
  Synthetic
gccaagcatttaggtgacactataggtacctatgtggaataagcagtttcagagctatgctggaaacagc

SEQ ID NO: 55119 - DNA, 70 bp, Artificial Sequence
  Synthetic
gccaagcatttaggtgacactatagtctcaaatcctgatgctgttgtttcagagctatgctggaaacagc

SEQ ID NO: 55120 - DNA, 70 bp, Artificial Sequence
  Synthetic
gccaagcatttaggtgacactatagcccagacaccttaaagcaaagtttcagagctatgctggaaacagc

SEQ ID NO: 55121 - DNA, 70 bp, Artificial Sequence
  Synthetic
gccaagcatttaggtgacactatagctttcaaacccagatgctatgtttcagagctatgctggaaacagc

SEQ ID NO: 55122 - DNA, 70 bp, Artificial Sequence
  Synthetic
gccaagcatttaggtgacactataggtcccgggataggttcaggggtttcagagctatgctggaaacagc

SEQ ID NO: 55123 - DNA, 70 bp, Artificial Sequence
  Synthetic
gccaagcatttaggtgacactatagccactcatggttgctatggcgtttcagagctatgctggaaacagc

SEQ ID NO: 55124 - DNA, 70 bp, Artificial Sequence
  Synthetic
gccaagcatttaggtgacactatagatcccagcgtcactcagctcgtttcagagctatgctggaaacagc

SEQ ID NO: 55125 - DNA, 70 bp, Artificial Sequence
  Synthetic
gccaagcatttaggtgacactatagatgaagtcccaggcgtaaaggtttcagagctatgctggaaacagc

SEQ ID NO: 55126 - DNA, 70 bp, Artificial Sequence
  Synthetic
gccaagcatttaggtgacactatagggggaaatggccatacatgggtttcagagctatgctggaaacagc

SEQ ID NO: 55127 - DNA, 70 bp, Artificial Sequence
  Synthetic
gccaagcatttaggtgacactatagcttcgccatacagctgacatgtttcagagctatgctggaaacagc

SEQ ID NO: 55128 - DNA, 70 bp, Artificial Sequence
  Synthetic
gccaagcatttaggtgacactatagacagaggagcttggctgaccgtttcagagctatgctggaaacagc

SEQ ID NO: 55129 - DNA, 70 bp, Artificial Sequence
  Synthetic
gccaagcatttaggtgacactataggcaagttgaaactgaaggaggtttcagagctatgctggaaacagc

SEQ ID NO: 55130 - DNA, 70 bp, Artificial Sequence
  Synthetic
gccaagcatttaggtgacactatagaacaagtacattccccttaggtttcagagctatgctggaaacagc

SEQ ID NO: 55131 - DNA, 70 bp, Artificial Sequence
  Synthetic
gccaagcatttaggtgacactataggggcttccaagtacgcatctgtttcagagctatgctggaaacagc

SEQ ID NO: 55132 - DNA, 70 bp, Artificial Sequence
  Synthetic
gccaagcatttaggtgacactatagccggggccactgcccgtcacgtttcagagctatgctggaaacagc

SEQ ID NO: 55133 - DNA, 70 bp, Artificial Sequence
  Synthetic
gccaagcatttaggtgacactatagacagatgtgaccctataatagtttcagagctatgctggaaacagc

SEQ ID NO: 55134 - DNA, 70 bp, Artificial Sequence
  Synthetic
gccaagcatttaggtgacactatagcagtcagtcacgagagcagagtttcagagctatgctggaaacagc

SEQ ID NO: 55135 - DNA, 70 bp, Artificial Sequence
  Synthetic
gccaagcatttaggtgacactatagcggtgagctccggtcaaacggtttcagagctatgctggaaacagc

SEQ ID NO: 55136 - DNA, 70 bp, Artificial Sequence
  Synthetic
gccaagcatttaggtgacactatagtcggtataaggatgatctaggtttcagagctatgctggaaacagc

SEQ ID NO: 55137 - DNA, 70 bp, Artificial Sequence
  Synthetic
gccaagcatttaggtgacactatagcacaagatgcgatcgtccgcgtttcagagctatgctggaaacagc

SEQ ID NO: 55138 - DNA, 70 bp, Artificial Sequence
  Synthetic
gccaagcatttaggtgacactatagaatgacagcaaagcactgtggtttcagagctatgctggaaacagc

SEQ ID NO: 55139 - DNA, 70 bp, Artificial Sequence
  Synthetic
gccaagcatttaggtgacactatagaggagcttttgccactgactgtttcagagctatgctggaaacagc

SEQ ID NO: 55140 - DNA, 70 bp, Artificial Sequence
  Synthetic
gccaagcatttaggtgacactatagacctggacagcgcggctcaggtttcagagctatgctggaaacagc

SEQ ID NO: 55141 - DNA, 70 bp, Artificial Sequence
  Synthetic
gccaagcatttaggtgacactataggcagccatgaagttaatatggtttcagagctatgctggaaacagc

SEQ ID NO: 55142 - DNA, 70 bp, Artificial Sequence
  Synthetic
gccaagcatttaggtgacactatagcttgaagatcaaactagctcgtttcagagctatgctggaaacagc

SEQ ID NO: 55143 - DNA, 70 bp, Artificial Sequence
  Synthetic
gccaagcatttaggtgacactatagagccctgggcaggcagtagggtttcagagctatgctggaaacagc

SEQ ID NO: 55144 - DNA, 70 bp, Artificial Sequence
  Synthetic
gccaagcatttaggtgacactatagaaaatgctcagacttcacaggtttcagagctatgctggaaacagc

SEQ ID NO: 55145 - DNA, 70 bp, Artificial Sequence
  Synthetic
gccaagcatttaggtgacactatagtcggtcacctgcagactaaagtttcagagctatgctggaaacagc

SEQ ID NO: 55146 - DNA, 70 bp, Artificial Sequence
  Synthetic
gccaagcatttaggtgacactatagagcatagccacccatgtcaggtttcagagctatgctggaaacagc

SEQ ID NO: 55147 - DNA, 70 bp, Artificial Sequence
  Synthetic
gccaagcatttaggtgacactatagctgcaagttctgcattcagagtttcagagctatgctggaaacagc

SEQ ID NO: 55148 - DNA, 70 bp, Artificial Sequence
  Synthetic
gccaagcatttaggtgacactatagtgggtatggacagggcctatgtttcagagctatgctggaaacagc

SEQ ID NO: 55149 - DNA, 70 bp, Artificial Sequence
  Synthetic
gccaagcatttaggtgacactatagcagtgcatgaggcgggctacgtttcagagctatgctggaaacagc

SEQ ID NO: 55150 - DNA, 70 bp, Artificial Sequence
  Synthetic
gccaagcatttaggtgacactatagcgggccgtggaggcctaggcgtttcagagctatgctggaaacagc

SEQ ID NO: 55151 - DNA, 70 bp, Artificial Sequence
  Synthetic
gccaagcatttaggtgacactatagcttctgaaaaaagcagccaggtttcagagctatgctggaaacagc

SEQ ID NO: 55152 - DNA, 70 bp, Artificial Sequence
  Synthetic
gccaagcatttaggtgacactatagcaaaatacacagagtgtgaggtttcagagctatgctggaaacagc

SEQ ID NO: 55153 - DNA, 70 bp, Artificial Sequence
  Synthetic
gccaagcatttaggtgacactatagataaagttttctggagctgcgtttcagagctatgctggaaacagc

SEQ ID NO: 55154 - DNA, 70 bp, Artificial Sequence
  Synthetic
gccaagcatttaggtgacactataggagaaatcccttttgaaggagtttcagagctatgctggaaacagc

SEQ ID NO: 55155 - DNA, 70 bp, Artificial Sequence
  Synthetic
gccaagcatttaggtgacactatagccttcacccacgtggttagggtttcagagctatgctggaaacagc

SEQ ID NO: 55156 - DNA, 70 bp, Artificial Sequence
  Synthetic
gccaagcatttaggtgacactatagaaactcaaggcatcaacaacgtttcagagctatgctggaaacagc

SEQ ID NO: 55157 - DNA, 70 bp, Artificial Sequence
  Synthetic
gccaagcatttaggtgacactatagatcaggtatttgtcctcatggtttcagagctatgctggaaacagc

SEQ ID NO: 55158 - DNA, 70 bp, Artificial Sequence
  Synthetic
gccaagcatttaggtgacactataggcacaggctcatggattgccgtttcagagctatgctggaaacagc

SEQ ID NO: 55159 - DNA, 70 bp, Artificial Sequence
  Synthetic
gccaagcatttaggtgacactatagcgccgctcggggtcctcagagtttcagagctatgctggaaacagc

SEQ ID NO: 55160 - DNA, 70 bp, Artificial Sequence
  Synthetic
gccaagcatttaggtgacactatagtgcggggagtcacagttagagtttcagagctatgctggaaacagc

SEQ ID NO: 55161 - DNA, 70 bp, Artificial Sequence
  Synthetic
gccaagcatttaggtgacactatagcggttcttacagatcgaatagtttcagagctatgctggaaacagc

SEQ ID NO: 55162 - DNA, 70 bp, Artificial Sequence
  Synthetic
gccaagcatttaggtgacactatagaggggggccaagggctcagagtttcagagctatgctggaaacagc

SEQ ID NO: 55163 - DNA, 70 bp, Artificial Sequence
  Synthetic
gccaagcatttaggtgacactatagtgccctcgggggtccctagagtttcagagctatgctggaaacagc

SEQ ID NO: 55164 - DNA, 70 bp, Artificial Sequence
  Synthetic
gccaagcatttaggtgacactatagggaggcaggtctctatctcagtttcagagctatgctggaaacagc

SEQ ID NO: 55165 - DNA, 70 bp, Artificial Sequence
  Synthetic
gccaagcatttaggtgacactatagcctcagtcatcagctgaccagtttcagagctatgctggaaacagc

SEQ ID NO: 55166 - DNA, 70 bp, Artificial Sequence
  Synthetic
gccaagcatttaggtgacactatagactcaatcctgattcaagtagtttcagagctatgctggaaacagc

SEQ ID NO: 55167 - DNA, 70 bp, Artificial Sequence
  Synthetic
gccaagcatttaggtgacactatagccattgcggctgtcattgcggtttcagagctatgctggaaacagc

SEQ ID NO: 55168 - DNA, 70 bp, Artificial Sequence
  Synthetic
gccaagcatttaggtgacactatagggctcctcgctgggtcaggagtttcagagctatgctggaaacagc

SEQ ID NO: 55169 - DNA, 70 bp, Artificial Sequence
  Synthetic
gccaagcatttaggtgacactataggcctcagtgtggtgttcagcgtttcagagctatgctggaaacagc

SEQ ID NO: 55170 - DNA, 70 bp, Artificial Sequence
  Synthetic
gccaagcatttaggtgacactatagactcaagtcagagaaacatggtttcagagctatgctggaaacagc

SEQ ID NO: 55171 - DNA, 70 bp, Artificial Sequence
  Synthetic
gccaagcatttaggtgacactatagggagtgtttgcttcaagtgagtttcagagctatgctggaaacagc

SEQ ID NO: 55172 - DNA, 70 bp, Artificial Sequence
  Synthetic
gccaagcatttaggtgacactatagtcacctctgagtcaggctaggtttcagagctatgctggaaacagc

SEQ ID NO: 55173 - DNA, 70 bp, Artificial Sequence
  Synthetic
gccaagcatttaggtgacactatagggctgcagatgacttcttaggtttcagagctatgctggaaacagc

SEQ ID NO: 55174 - DNA, 70 bp, Artificial Sequence
  Synthetic
gccaagcatttaggtgacactatagaggcaacttatctcaaatgcgtttcagagctatgctggaaacagc

SEQ ID NO: 55175 - DNA, 70 bp, Artificial Sequence
  Synthetic
gccaagcatttaggtgacactatagtctcgatagtgaggaggatggtttcagagctatgctggaaacagc

SEQ ID NO: 55176 - DNA, 70 bp, Artificial Sequence
  Synthetic
gccaagcatttaggtgacactatagtcaagattgggaaatgtgatgtttcagagctatgctggaaacagc

SEQ ID NO: 55177 - DNA, 70 bp, Artificial Sequence
  Synthetic
gccaagcatttaggtgacactatagctctgtgagacaaggtccttgtttcagagctatgctggaaacagc

SEQ ID NO: 55178 - DNA, 70 bp, Artificial Sequence
  Synthetic
gccaagcatttaggtgacactatagctatgagagggctctgaggcgtttcagagctatgctggaaacagc

SEQ ID NO: 55179 - DNA, 70 bp, Artificial Sequence
  Synthetic
gccaagcatttaggtgacactatagttcagcatcaagctggaatggtttcagagctatgctggaaacagc

SEQ ID NO: 55180 - DNA, 70 bp, Artificial Sequence
  Synthetic
gccaagcatttaggtgacactatagtcagttgctctgagttagaggtttcagagctatgctggaaacagc

SEQ ID NO: 55181 - DNA, 70 bp, Artificial Sequence
  Synthetic
gccaagcatttaggtgacactatagggagctcacagagagcagtcgtttcagagctatgctggaaacagc

SEQ ID NO: 55182 - DNA, 70 bp, Artificial Sequence
  Synthetic
gccaagcatttaggtgacactatagttcatcctgttactggtattgtttcagagctatgctggaaacagc

SEQ ID NO: 55183 - DNA, 70 bp, Artificial Sequence
  Synthetic
gccaagcatttaggtgacactatagcagtgctcaagagtcccacagtttcagagctatgctggaaacagc

SEQ ID NO: 55184 - DNA, 70 bp, Artificial Sequence
  Synthetic
gccaagcatttaggtgacactataggatgcctcctgatctatcgcgtttcagagctatgctggaaacagc

SEQ ID NO: 55185 - DNA, 70 bp, Artificial Sequence
  Synthetic
gccaagcatttaggtgacactatagatgcctcctgatctatccatgtttcagagctatgctggaaacagc

SEQ ID NO: 55186 - DNA, 70 bp, Artificial Sequence
  Synthetic
gccaagcatttaggtgacactatagtgacgcggactatgactgacgtttcagagctatgctggaaacagc

SEQ ID NO: 55187 - DNA, 70 bp, Artificial Sequence
  Synthetic
gccaagcatttaggtgacactataggcaagaaagattaaggaggagtttcagagctatgctggaaacagc

SEQ ID NO: 55188 - DNA, 70 bp, Artificial Sequence
  Synthetic
gccaagcatttaggtgacactatagagaaatacagcccttgtgccgtttcagagctatgctggaaacagc

SEQ ID NO: 55189 - DNA, 70 bp, Artificial Sequence
  Synthetic
gccaagcatttaggtgacactatagtcaagaaagattaaggaggagtttcagagctatgctggaaacagc

SEQ ID NO: 55190 - DNA, 70 bp, Artificial Sequence
  Synthetic
gccaagcatttaggtgacactataggcaagtttgttgaaaacgaggtttcagagctatgctggaaacagc

SEQ ID NO: 55191 - DNA, 70 bp, Artificial Sequence
  Synthetic
gccaagcatttaggtgacactataggcaagaaaggttaaggaggagtttcagagctatgctggaaacagc

SEQ ID NO: 55192 - DNA, 70 bp, Artificial Sequence
  Synthetic
gccaagcatttaggtgacactatagatacagctcttgtgcctggggtttcagagctatgctggaaacagc

SEQ ID NO: 55193 - DNA, 70 bp, Artificial Sequence
  Synthetic
gccaagcatttaggtgacactatagaacaagtgaagaactacagcgtttcagagctatgctggaaacagc

SEQ ID NO: 55194 - DNA, 70 bp, Artificial Sequence
  Synthetic
gccaagcatttaggtgacactatagaaacttaatcactggggcacgtttcagagctatgctggaaacagc

SEQ ID NO: 55195 - DNA, 70 bp, Artificial Sequence
  Synthetic
gccaagcatttaggtgacactatagcaccctccttccacctggccgtttcagagctatgctggaaacagc

SEQ ID NO: 55196 - DNA, 70 bp, Artificial Sequence
  Synthetic
gccaagcatttaggtgacactatagtcagatgttgaccttggggagtttcagagctatgctggaaacagc

SEQ ID NO: 55197 - DNA, 70 bp, Artificial Sequence
  Synthetic
gccaagcatttaggtgacactatagggctaggagatcttcagtttgtttcagagctatgctggaaacagc

SEQ ID NO: 55198 - DNA, 70 bp, Artificial Sequence
  Synthetic
gccaagcatttaggtgacactataggtttagaagcccgaggtagggtttcagagctatgctggaaacagc

SEQ ID NO: 55199 - DNA, 70 bp, Artificial Sequence
  Synthetic
gccaagcatttaggtgacactataggcaggcaggacaaccattacgtttcagagctatgctggaaacagc

SEQ ID NO: 55200 - DNA, 70 bp, Artificial Sequence
  Synthetic
gccaagcatttaggtgacactatagtgttggtctataaccaatcagtttcagagctatgctggaaacagc

SEQ ID NO: 55201 - DNA, 70 bp, Artificial Sequence
  Synthetic
gccaagcatttaggtgacactatagatgctttggttcaaagcgttgtttcagagctatgctggaaacagc

SEQ ID NO: 55202 - DNA, 70 bp, Artificial Sequence
  Synthetic
gccaagcatttaggtgacactatagaatttacagctctattcagggtttcagagctatgctggaaacagc

SEQ ID NO: 55203 - DNA, 70 bp, Artificial Sequence
  Synthetic
gccaagcatttaggtgacactatagataaggtgtggggtgtcagggtttcagagctatgctggaaacagc

SEQ ID NO: 55204 - DNA, 70 bp, Artificial Sequence
  Synthetic
gccaagcatttaggtgacactatagggtgggagggtcagacacacgtttcagagctatgctggaaacagc

SEQ ID NO: 55205 - DNA, 70 bp, Artificial Sequence
  Synthetic
gccaagcatttaggtgacactatagggcggaagggtcagacacacgtttcagagctatgctggaaacagc

SEQ ID NO: 55206 - DNA, 70 bp, Artificial Sequence
  Synthetic
gccaagcatttaggtgacactataggccagagggggcggggtcaggtttcagagctatgctggaaacagc

SEQ ID NO: 55207 - DNA, 70 bp, Artificial Sequence
  Synthetic
gccaagcatttaggtgacactatagatgtcgggggacagctcaccgtttcagagctatgctggaaacagc

SEQ ID NO: 55208 - DNA, 70 bp, Artificial Sequence
  Synthetic
gccaagcatttaggtgacactatagaatcatttcaagatgagcccgtttcagagctatgctggaaacagc

SEQ ID NO: 55209 - DNA, 70 bp, Artificial Sequence
  Synthetic
gccaagcatttaggtgacactatagcgagataagagagcagatgtgtttcagagctatgctggaaacagc

SEQ ID NO: 55210 - DNA, 70 bp, Artificial Sequence
  Synthetic
gccaagcatttaggtgacactatagttcagcaggtcctgcttcacgtttcagagctatgctggaaacagc

SEQ ID NO: 55211 - DNA, 70 bp, Artificial Sequence
  Synthetic
gccaagcatttaggtgacactataggtccccaggatgctggtcatgtttcagagctatgctggaaacagc

SEQ ID NO: 55212 - DNA, 70 bp, Artificial Sequence
  Synthetic
gccaagcatttaggtgacactatagctggggcccaggcccctcaggtttcagagctatgctggaaacagc

SEQ ID NO: 55213 - DNA, 70 bp, Artificial Sequence
  Synthetic
gccaagcatttaggtgacactatagcagcttttcctttcagtagtgtttcagagctatgctggaaacagc

SEQ ID NO: 55214 - DNA, 70 bp, Artificial Sequence
  Synthetic
gccaagcatttaggtgacactataggagcaagttccgagcaccgagtttcagagctatgctggaaacagc

SEQ ID NO: 55215 - DNA, 70 bp, Artificial Sequence
  Synthetic
gccaagcatttaggtgacactatagggccagtttcagaaaatagtgtttcagagctatgctggaaacagc

SEQ ID NO: 55216 - DNA, 70 bp, Artificial Sequence
  Synthetic
gccaagcatttaggtgacactataggtctgagagcagagacaggggtttcagagctatgctggaaacagc

SEQ ID NO: 55217 - DNA, 70 bp, Artificial Sequence
  Synthetic
gccaagcatttaggtgacactatagctgctccagctcgtcatgccgtttcagagctatgctggaaacagc

SEQ ID NO: 55218 - DNA, 70 bp, Artificial Sequence
  Synthetic
gccaagcatttaggtgacactataggtgacgggctcaggtgtgccgtttcagagctatgctggaaacagc

SEQ ID NO: 55219 - DNA, 70 bp, Artificial Sequence
  Synthetic
gccaagcatttaggtgacactatagtctaacacagtgttcaacatgtttcagagctatgctggaaacagc

SEQ ID NO: 55220 - DNA, 70 bp, Artificial Sequence
  Synthetic
gccaagcatttaggtgacactatagttgggaagtgtctcagctgagtttcagagctatgctggaaacagc

SEQ ID NO: 55221 - DNA, 70 bp, Artificial Sequence
  Synthetic
gccaagcatttaggtgacactatagatggtcttcagaaattgttcgtttcagagctatgctggaaacagc

SEQ ID NO: 55222 - DNA, 70 bp, Artificial Sequence
  Synthetic
gccaagcatttaggtgacactatagctcctctgagaaggcacggcgtttcagagctatgctggaaacagc

SEQ ID NO: 55223 - DNA, 70 bp, Artificial Sequence
  Synthetic
gccaagcatttaggtgacactataggtttcccaggctggagtgcagtttcagagctatgctggaaacagc

SEQ ID NO: 55224 - DNA, 70 bp, Artificial Sequence
  Synthetic
gccaagcatttaggtgacactataggttattccagaaccagcaacgtttcagagctatgctggaaacagc

SEQ ID NO: 55225 - DNA, 70 bp, Artificial Sequence
  Synthetic
gccaagcatttaggtgacactatagattttccatccatagttggtgtttcagagctatgctggaaacagc

SEQ ID NO: 55226 - DNA, 70 bp, Artificial Sequence
  Synthetic
gccaagcatttaggtgacactataggacttaaactcagtttccgcgtttcagagctatgctggaaacagc

SEQ ID NO: 55227 - DNA, 70 bp, Artificial Sequence
  Synthetic
gccaagcatttaggtgacactatagttgccagctttaaaatcatcgtttcagagctatgctggaaacagc

SEQ ID NO: 55228 - DNA, 70 bp, Artificial Sequence
  Synthetic
gccaagcatttaggtgacactatagagccaatccagcaagagtatgtttcagagctatgctggaaacagc

SEQ ID NO: 55229 - DNA, 70 bp, Artificial Sequence
  Synthetic
gccaagcatttaggtgacactatagtgtagtccgagcttctcagggtttcagagctatgctggaaacagc

SEQ ID NO: 55230 - DNA, 70 bp, Artificial Sequence
  Synthetic
gccaagcatttaggtgacactatagttcaggagggtggggaggacgtttcagagctatgctggaaacagc

SEQ ID NO: 55231 - DNA, 70 bp, Artificial Sequence
  Synthetic
gccaagcatttaggtgacactatagaaaagagaaggaagtgctaggtttcagagctatgctggaaacagc

SEQ ID NO: 55232 - DNA, 70 bp, Artificial Sequence
  Synthetic
gccaagcatttaggtgacactatagagccaagaaaaggatcgatggtttcagagctatgctggaaacagc

SEQ ID NO: 55233 - DNA, 70 bp, Artificial Sequence
  Synthetic
gccaagcatttaggtgacactatagtatgggaaccgacagaacatgtttcagagctatgctggaaacagc

SEQ ID NO: 55234 - DNA, 70 bp, Artificial Sequence
  Synthetic
gccaagcatttaggtgacactatagggttacccagccagctcactgtttcagagctatgctggaaacagc

SEQ ID NO: 55235 - DNA, 70 bp, Artificial Sequence
  Synthetic
gccaagcatttaggtgacactatagctctgggaagagctaggcaggtttcagagctatgctggaaacagc

SEQ ID NO: 55236 - DNA, 70 bp, Artificial Sequence
  Synthetic
gccaagcatttaggtgacactatagaaacaagaactacaggatgtgtttcagagctatgctggaaacagc

SEQ ID NO: 55237 - DNA, 70 bp, Artificial Sequence
  Synthetic
gccaagcatttaggtgacactatagatttgaagaacgcaagtagagtttcagagctatgctggaaacagc

SEQ ID NO: 55238 - DNA, 70 bp, Artificial Sequence
  Synthetic
gccaagcatttaggtgacactataggctgaatgcagaggcaaaaagtttcagagctatgctggaaacagc

SEQ ID NO: 55239 - DNA, 70 bp, Artificial Sequence
  Synthetic
gccaagcatttaggtgacactatagttcaggatccaaggatcagcgtttcagagctatgctggaaacagc

SEQ ID NO: 55240 - DNA, 70 bp, Artificial Sequence
  Synthetic
gccaagcatttaggtgacactatagttttgctcacttccgattgcgtttcagagctatgctggaaacagc

SEQ ID NO: 55241 - DNA, 70 bp, Artificial Sequence
  Synthetic
gccaagcatttaggtgacactataggtaaccaggcccaggcacgggtttcagagctatgctggaaacagc

SEQ ID NO: 55242 - DNA, 70 bp, Artificial Sequence
  Synthetic
gccaagcatttaggtgacactataggcctcacagcgcagcaagtggtttcagagctatgctggaaacagc

SEQ ID NO: 55243 - DNA, 70 bp, Artificial Sequence
  Synthetic
gccaagcatttaggtgacactatagctcagtcaagacggaagtaagtttcagagctatgctggaaacagc

SEQ ID NO: 55244 - DNA, 70 bp, Artificial Sequence
  Synthetic
gccaagcatttaggtgacactatagtgcggagtcagatgtgtaaggtttcagagctatgctggaaacagc

SEQ ID NO: 55245 - DNA, 70 bp, Artificial Sequence
  Synthetic
gccaagcatttaggtgacactatagcactttgctccctgctgaccgtttcagagctatgctggaaacagc

SEQ ID NO: 55246 - DNA, 70 bp, Artificial Sequence
  Synthetic
gccaagcatttaggtgacactatagcctgggtctccagagatcaggtttcagagctatgctggaaacagc

SEQ ID NO: 55247 - DNA, 70 bp, Artificial Sequence
  Synthetic
gccaagcatttaggtgacactatagctgcggtctactgcatccgcgtttcagagctatgctggaaacagc

SEQ ID NO: 55248 - DNA, 70 bp, Artificial Sequence
  Synthetic
gccaagcatttaggtgacactatagctacaccaccaaggggaagggtttcagagctatgctggaaacagc

SEQ ID NO: 55249 - DNA, 70 bp, Artificial Sequence
  Synthetic
gccaagcatttaggtgacactataggctgacagctttcgagagtggtttcagagctatgctggaaacagc

SEQ ID NO: 55250 - DNA, 70 bp, Artificial Sequence
  Synthetic
gccaagcatttaggtgacactatagctcaacgttgctgctgtcgagtttcagagctatgctggaaacagc

SEQ ID NO: 55251 - DNA, 70 bp, Artificial Sequence
  Synthetic
gccaagcatttaggtgacactatagtcctgccccactgggagtaggtttcagagctatgctggaaacagc

SEQ ID NO: 55252 - DNA, 70 bp, Artificial Sequence
  Synthetic
gccaagcatttaggtgacactatagagcatcagcaaaaattacaggtttcagagctatgctggaaacagc

SEQ ID NO: 55253 - DNA, 70 bp, Artificial Sequence
  Synthetic
gccaagcatttaggtgacactatagtattctggaggtttatagctgtttcagagctatgctggaaacagc

SEQ ID NO: 55254 - DNA, 70 bp, Artificial Sequence
  Synthetic
gccaagcatttaggtgacactatagctcccgatgaccgcatgtgagtttcagagctatgctggaaacagc

SEQ ID NO: 55255 - DNA, 70 bp, Artificial Sequence
  Synthetic
gccaagcatttaggtgacactatagcagcccggacctcggatgacgtttcagagctatgctggaaacagc

SEQ ID NO: 55256 - DNA, 70 bp, Artificial Sequence
  Synthetic
gccaagcatttaggtgacactatagtactggagatgggagatgaggtttcagagctatgctggaaacagc

SEQ ID NO: 55257 - DNA, 70 bp, Artificial Sequence
  Synthetic
gccaagcatttaggtgacactatagccatctcccggagctgtaccgtttcagagctatgctggaaacagc

SEQ ID NO: 55258 - DNA, 70 bp, Artificial Sequence
  Synthetic
gccaagcatttaggtgacactatagaccccagaacagtctagatggtttcagagctatgctggaaacagc

SEQ ID NO: 55259 - DNA, 70 bp, Artificial Sequence
  Synthetic
gccaagcatttaggtgacactatagcactacttccactcctgagcgtttcagagctatgctggaaacagc

SEQ ID NO: 55260 - DNA, 70 bp, Artificial Sequence
  Synthetic
gccaagcatttaggtgacactatagtggctcatctggggtttgctgtttcagagctatgctggaaacagc

SEQ ID NO: 55261 - DNA, 70 bp, Artificial Sequence
  Synthetic
gccaagcatttaggtgacactatagggtgaggtgaggctaggtgcgtttcagagctatgctggaaacagc

SEQ ID NO: 55262 - DNA, 70 bp, Artificial Sequence
  Synthetic
gccaagcatttaggtgacactataggaaggagagggggacgtgacgtttcagagctatgctggaaacagc

SEQ ID NO: 55263 - DNA, 70 bp, Artificial Sequence
  Synthetic
gccaagcatttaggtgacactatagcaaacgtgttgtgcatcagcgtttcagagctatgctggaaacagc

SEQ ID NO: 55264 - DNA, 70 bp, Artificial Sequence
  Synthetic
gccaagcatttaggtgacactatagggcccctgcagaatgttcatgtttcagagctatgctggaaacagc

SEQ ID NO: 55265 - DNA, 70 bp, Artificial Sequence
  Synthetic
gccaagcatttaggtgacactataggttggcttggagctcctcaggtttcagagctatgctggaaacagc

SEQ ID NO: 55266 - DNA, 70 bp, Artificial Sequence
  Synthetic
gccaagcatttaggtgacactatagggcccctacagaatgttcatgtttcagagctatgctggaaacagc

SEQ ID NO: 55267 - DNA, 70 bp, Artificial Sequence
  Synthetic
gccaagcatttaggtgacactatagctggctgtggtggagaatgtgtttcagagctatgctggaaacagc

SEQ ID NO: 55268 - DNA, 70 bp, Artificial Sequence
  Synthetic
gccaagcatttaggtgacactatagaacctctcagagaatctctggtttcagagctatgctggaaacagc

SEQ ID NO: 55269 - DNA, 70 bp, Artificial Sequence
  Synthetic
gccaagcatttaggtgacactataggttgtcccaggtatcatggcgtttcagagctatgctggaaacagc

SEQ ID NO: 55270 - DNA, 70 bp, Artificial Sequence
  Synthetic
gccaagcatttaggtgacactataggctgcataatcactaccaaggtttcagagctatgctggaaacagc

SEQ ID NO: 55271 - DNA, 70 bp, Artificial Sequence
  Synthetic
gccaagcatttaggtgacactatagtcgggccgggtccttggtatgtttcagagctatgctggaaacagc

SEQ ID NO: 55272 - DNA, 70 bp, Artificial Sequence
  Synthetic
gccaagcatttaggtgacactatagtgattctggagctgacgtgagtttcagagctatgctggaaacagc

SEQ ID NO: 55273 - DNA, 70 bp, Artificial Sequence
  Synthetic
gccaagcatttaggtgacactataggcttggctggagctcacatggtttcagagctatgctggaaacagc

SEQ ID NO: 55274 - DNA, 70 bp, Artificial Sequence
  Synthetic
gccaagcatttaggtgacactatagaggactgacaggcagagaatgtttcagagctatgctggaaacagc

SEQ ID NO: 55275 - DNA, 70 bp, Artificial Sequence
  Synthetic
gccaagcatttaggtgacactatagccaggggccatagactaagcgtttcagagctatgctggaaacagc

SEQ ID NO: 55276 - DNA, 70 bp, Artificial Sequence
  Synthetic
gccaagcatttaggtgacactataggttgtattactgaccttctcgtttcagagctatgctggaaacagc

SEQ ID NO: 55277 - DNA, 70 bp, Artificial Sequence
  Synthetic
gccaagcatttaggtgacactatagtttctatggcctttcatagtgtttcagagctatgctggaaacagc

SEQ ID NO: 55278 - DNA, 70 bp, Artificial Sequence
  Synthetic
gccaagcatttaggtgacactatagtcatgaagaggcttcgaaaagtttcagagctatgctggaaacagc

SEQ ID NO: 55279 - DNA, 70 bp, Artificial Sequence
  Synthetic
gccaagcatttaggtgacactatagcagggatgttcacagcagaggtttcagagctatgctggaaacagc

SEQ ID NO: 55280 - DNA, 70 bp, Artificial Sequence
  Synthetic
gccaagcatttaggtgacactatagggggtggagtcacagcaaaggtttcagagctatgctggaaacagc

SEQ ID NO: 55281 - DNA, 70 bp, Artificial Sequence
  Synthetic
gccaagcatttaggtgacactataggtccggggcagggagctgaagtttcagagctatgctggaaacagc

SEQ ID NO: 55282 - DNA, 70 bp, Artificial Sequence
  Synthetic
gccaagcatttaggtgacactataggaagaagatggaagctgatggtttcagagctatgctggaaacagc

SEQ ID NO: 55283 - DNA, 70 bp, Artificial Sequence
  Synthetic
gccaagcatttaggtgacactatagaatagtccaagctgagattagtttcagagctatgctggaaacagc

SEQ ID NO: 55284 - DNA, 70 bp, Artificial Sequence
  Synthetic
gccaagcatttaggtgacactatagtactcaagtacaggagaaaagtttcagagctatgctggaaacagc

SEQ ID NO: 55285 - DNA, 70 bp, Artificial Sequence
  Synthetic
gccaagcatttaggtgacactatagctggagcaggcctcatgatggtttcagagctatgctggaaacagc

SEQ ID NO: 55286 - DNA, 70 bp, Artificial Sequence
  Synthetic
gccaagcatttaggtgacactatagccccatggagctcagacatcgtttcagagctatgctggaaacagc

SEQ ID NO: 55287 - DNA, 70 bp, Artificial Sequence
  Synthetic
gccaagcatttaggtgacactatagctgcgaggggatgaagctgcgtttcagagctatgctggaaacagc

SEQ ID NO: 55288 - DNA, 70 bp, Artificial Sequence
  Synthetic
gccaagcatttaggtgacactataggtcatggagtgcattgagtagtttcagagctatgctggaaacagc

SEQ ID NO: 55289 - DNA, 70 bp, Artificial Sequence
  Synthetic
gccaagcatttaggtgacactatagatatggggctgatgactttagtttcagagctatgctggaaacagc

SEQ ID NO: 55290 - DNA, 70 bp, Artificial Sequence
  Synthetic
gccaagcatttaggtgacactatagcgggagggctttagctcatggtttcagagctatgctggaaacagc

SEQ ID NO: 55291 - DNA, 70 bp, Artificial Sequence
  Synthetic
gccaagcatttaggtgacactatagtgttacttcgcagatgctgcgtttcagagctatgctggaaacagc

SEQ ID NO: 55292 - DNA, 70 bp, Artificial Sequence
  Synthetic
gccaagcatttaggtgacactatagtttggaatgaaaaggcctaggtttcagagctatgctggaaacagc

SEQ ID NO: 55293 - DNA, 70 bp, Artificial Sequence
  Synthetic
gccaagcatttaggtgacactataggaccagatattcacttcagcgtttcagagctatgctggaaacagc

SEQ ID NO: 55294 - DNA, 70 bp, Artificial Sequence
  Synthetic
gccaagcatttaggtgacactatagtggtcagtgaagccgacaccgtttcagagctatgctggaaacagc

SEQ ID NO: 55295 - DNA, 70 bp, Artificial Sequence
  Synthetic
gccaagcatttaggtgacactataggtccggggggagcataaggtgtttcagagctatgctggaaacagc

SEQ ID NO: 55296 - DNA, 70 bp, Artificial Sequence
  Synthetic
gccaagcatttaggtgacactatagttgcctgtcattttgcaagagtttcagagctatgctggaaacagc

SEQ ID NO: 55297 - DNA, 70 bp, Artificial Sequence
  Synthetic
gccaagcatttaggtgacactatagtcgtatcttcattgtcatgtgtttcagagctatgctggaaacagc

SEQ ID NO: 55298 - DNA, 70 bp, Artificial Sequence
  Synthetic
gccaagcatttaggtgacactatagctgcagtcaagtgagtgactgtttcagagctatgctggaaacagc

SEQ ID NO: 55299 - DNA, 70 bp, Artificial Sequence
  Synthetic
gccaagcatttaggtgacactatagtccttctcagagcctagcttgtttcagagctatgctggaaacagc

SEQ ID NO: 55300 - DNA, 70 bp, Artificial Sequence
  Synthetic
gccaagcatttaggtgacactatagctgaagactcggctgtgaccgtttcagagctatgctggaaacagc

SEQ ID NO: 55301 - DNA, 70 bp, Artificial Sequence
  Synthetic
gccaagcatttaggtgacactatagagccctcctgggtcctctacgtttcagagctatgctggaaacagc

SEQ ID NO: 55302 - DNA, 70 bp, Artificial Sequence
  Synthetic
gccaagcatttaggtgacactatagtcttcatgctttcagaattcgtttcagagctatgctggaaacagc

SEQ ID NO: 55303 - DNA, 70 bp, Artificial Sequence
  Synthetic
gccaagcatttaggtgacactatagggcatctgtgccctgcagttgtttcagagctatgctggaaacagc

SEQ ID NO: 55304 - DNA, 70 bp, Artificial Sequence
  Synthetic
gccaagcatttaggtgacactatagacagagttgtccttggaggagtttcagagctatgctggaaacagc

SEQ ID NO: 55305 - DNA, 70 bp, Artificial Sequence
  Synthetic
gccaagcatttaggtgacactataggagaatctcttgaatctggagtttcagagctatgctggaaacagc

SEQ ID NO: 55306 - DNA, 70 bp, Artificial Sequence
  Synthetic
gccaagcatttaggtgacactatagggaggatggagacaggtgcagtttcagagctatgctggaaacagc

SEQ ID NO: 55307 - DNA, 70 bp, Artificial Sequence
  Synthetic
gccaagcatttaggtgacactatagcggttcaggatcttcaggcggtttcagagctatgctggaaacagc

SEQ ID NO: 55308 - DNA, 70 bp, Artificial Sequence
  Synthetic
gccaagcatttaggtgacactataggtctatcaggagcctgtccagtttcagagctatgctggaaacagc

SEQ ID NO: 55309 - DNA, 70 bp, Artificial Sequence
  Synthetic
gccaagcatttaggtgacactatagtgactccctcatgctctgaggtttcagagctatgctggaaacagc

SEQ ID NO: 55310 - DNA, 70 bp, Artificial Sequence
  Synthetic
gccaagcatttaggtgacactatagcgaggtggcccagtttgtaagtttcagagctatgctggaaacagc

SEQ ID NO: 55311 - DNA, 70 bp, Artificial Sequence
  Synthetic
gccaagcatttaggtgacactatagtgaagaaagcctctcagtgagtttcagagctatgctggaaacagc

SEQ ID NO: 55312 - DNA, 70 bp, Artificial Sequence
  Synthetic
gccaagcatttaggtgacactatagtggcttacgcaaaagcagacgtttcagagctatgctggaaacagc

SEQ ID NO: 55313 - DNA, 70 bp, Artificial Sequence
  Synthetic
gccaagcatttaggtgacactatagcaaagaatgtgaggaactgggtttcagagctatgctggaaacagc

SEQ ID NO: 55314 - DNA, 70 bp, Artificial Sequence
  Synthetic
gccaagcatttaggtgacactatagctggtttccccgagtttcatgtttcagagctatgctggaaacagc

SEQ ID NO: 55315 - DNA, 70 bp, Artificial Sequence
  Synthetic
gccaagcatttaggtgacactataggctggacatacatgctcagtgtttcagagctatgctggaaacagc

SEQ ID NO: 55316 - DNA, 70 bp, Artificial Sequence
  Synthetic
gccaagcatttaggtgacactataggctgctggagactcctaggcgtttcagagctatgctggaaacagc

SEQ ID NO: 55317 - DNA, 70 bp, Artificial Sequence
  Synthetic
gccaagcatttaggtgacactatagcccagagctcttaggccacagtttcagagctatgctggaaacagc

SEQ ID NO: 55318 - DNA, 70 bp, Artificial Sequence
  Synthetic
gccaagcatttaggtgacactatagccaggtgattcagaagatgcgtttcagagctatgctggaaacagc

SEQ ID NO: 55319 - DNA, 70 bp, Artificial Sequence
  Synthetic
gccaagcatttaggtgacactataggcctcggcggtcacactgaagtttcagagctatgctggaaacagc

SEQ ID NO: 55320 - DNA, 70 bp, Artificial Sequence
  Synthetic
gccaagcatttaggtgacactatagcggggcaggaccggcctcaggtttcagagctatgctggaaacagc

SEQ ID NO: 55321 - DNA, 70 bp, Artificial Sequence
  Synthetic
gccaagcatttaggtgacactatagcatccaccatgtgcagtaaggtttcagagctatgctggaaacagc

SEQ ID NO: 55322 - DNA, 70 bp, Artificial Sequence
  Synthetic
gccaagcatttaggtgacactatagcagaggggcccagtgcatgagtttcagagctatgctggaaacagc

SEQ ID NO: 55323 - DNA, 70 bp, Artificial Sequence
  Synthetic
gccaagcatttaggtgacactatagcttctcatgggtgggctacagtttcagagctatgctggaaacagc

SEQ ID NO: 55324 - DNA, 70 bp, Artificial Sequence
  Synthetic
gccaagcatttaggtgacactatagcgggacctggggcgggggacgtttcagagctatgctggaaacagc

SEQ ID NO: 55325 - DNA, 70 bp, Artificial Sequence
  Synthetic
gccaagcatttaggtgacactataggttacaaaggggcgaccgcggtttcagagctatgctggaaacagc

SEQ ID NO: 55326 - DNA, 70 bp, Artificial Sequence
  Synthetic
gccaagcatttaggtgacactataggcggcgcctggtgggagcgcgtttcagagctatgctggaaacagc

SEQ ID NO: 55327 - DNA, 70 bp, Artificial Sequence
  Synthetic
gccaagcatttaggtgacactatagggtggagctctgctcaacctgtttcagagctatgctggaaacagc

SEQ ID NO: 55328 - DNA, 70 bp, Artificial Sequence
  Synthetic
gccaagcatttaggtgacactatagctccctgggaaggtctaggagtttcagagctatgctggaaacagc

SEQ ID NO: 55329 - DNA, 70 bp, Artificial Sequence
  Synthetic
gccaagcatttaggtgacactatagtgcatcttattatcatgtccgtttcagagctatgctggaaacagc

SEQ ID NO: 55330 - DNA, 70 bp, Artificial Sequence
  Synthetic
gccaagcatttaggtgacactatagaatgctgggcattagttcacgtttcagagctatgctggaaacagc

SEQ ID NO: 55331 - DNA, 70 bp, Artificial Sequence
  Synthetic
gccaagcatttaggtgacactatagcacagcagtccacagcagcagtttcagagctatgctggaaacagc

SEQ ID NO: 55332 - DNA, 70 bp, Artificial Sequence
  Synthetic
gccaagcatttaggtgacactatagggtcaaggttgtgctgctgcgtttcagagctatgctggaaacagc

SEQ ID NO: 55333 - DNA, 70 bp, Artificial Sequence
  Synthetic
gccaagcatttaggtgacactataggattaagactcggaaagaacgtttcagagctatgctggaaacagc

SEQ ID NO: 55334 - DNA, 70 bp, Artificial Sequence
  Synthetic
gccaagcatttaggtgacactatagggagctcccagcctaaggaagtttcagagctatgctggaaacagc

SEQ ID NO: 55335 - DNA, 70 bp, Artificial Sequence
  Synthetic
gccaagcatttaggtgacactatagagctcgacgtctttctagccgtttcagagctatgctggaaacagc

SEQ ID NO: 55336 - DNA, 70 bp, Artificial Sequence
  Synthetic
gccaagcatttaggtgacactatagtgagactccagacctacgccgtttcagagctatgctggaaacagc

SEQ ID NO: 55337 - DNA, 70 bp, Artificial Sequence
  Synthetic
gccaagcatttaggtgacactatagttaggaagacacaaattgcagtttcagagctatgctggaaacagc

SEQ ID NO: 55338 - DNA, 70 bp, Artificial Sequence
  Synthetic
gccaagcatttaggtgacactatagtactttgaacagagctggtagtttcagagctatgctggaaacagc

SEQ ID NO: 55339 - DNA, 70 bp, Artificial Sequence
  Synthetic
gccaagcatttaggtgacactatagaggacttgtgtgcccttatagtttcagagctatgctggaaacagc

SEQ ID NO: 55340 - DNA, 70 bp, Artificial Sequence
  Synthetic
gccaagcatttaggtgacactatagcacgtgcctctcgggtagcagtttcagagctatgctggaaacagc

SEQ ID NO: 55341 - DNA, 70 bp, Artificial Sequence
  Synthetic
gccaagcatttaggtgacactatagcagatggtctgactgtgctagtttcagagctatgctggaaacagc

SEQ ID NO: 55342 - DNA, 70 bp, Artificial Sequence
  Synthetic
gccaagcatttaggtgacactataggaggggccacgccagtaagtgtttcagagctatgctggaaacagc

SEQ ID NO: 55343 - DNA, 70 bp, Artificial Sequence
  Synthetic
gccaagcatttaggtgacactatagaagcagaaaggtaatagatggtttcagagctatgctggaaacagc

SEQ ID NO: 55344 - DNA, 70 bp, Artificial Sequence
  Synthetic
gccaagcatttaggtgacactatagccaccacacacagtaattatgtttcagagctatgctggaaacagc

SEQ ID NO: 55345 - DNA, 70 bp, Artificial Sequence
  Synthetic
gccaagcatttaggtgacactatagcggtctagcagtgatgagcagtttcagagctatgctggaaacagc

SEQ ID NO: 55346 - DNA, 70 bp, Artificial Sequence
  Synthetic
gccaagcatttaggtgacactatagccagtatatccagtgtgatagtttcagagctatgctggaaacagc

SEQ ID NO: 55347 - DNA, 70 bp, Artificial Sequence
  Synthetic
gccaagcatttaggtgacactatagactggtaaagctaagctcttgtttcagagctatgctggaaacagc

SEQ ID NO: 55348 - DNA, 70 bp, Artificial Sequence
  Synthetic
gccaagcatttaggtgacactatagacagcaggcactattgcttcgtttcagagctatgctggaaacagc

SEQ ID NO: 55349 - DNA, 70 bp, Artificial Sequence
  Synthetic
gccaagcatttaggtgacactatagtctcagaaacactccttactgtttcagagctatgctggaaacagc

SEQ ID NO: 55350 - DNA, 70 bp, Artificial Sequence
  Synthetic
gccaagcatttaggtgacactatagaagaagtgtactctcacgacgtttcagagctatgctggaaacagc

SEQ ID NO: 55351 - DNA, 70 bp, Artificial Sequence
  Synthetic
gccaagcatttaggtgacactatagggcagtactactcgtcctccgtttcagagctatgctggaaacagc

SEQ ID NO: 55352 - DNA, 70 bp, Artificial Sequence
  Synthetic
gccaagcatttaggtgacactatagtgagatgatgctttgacaaagtttcagagctatgctggaaacagc

SEQ ID NO: 55353 - DNA, 70 bp, Artificial Sequence
  Synthetic
gccaagcatttaggtgacactataggatggaggagacagaatagggtttcagagctatgctggaaacagc

SEQ ID NO: 55354 - DNA, 70 bp, Artificial Sequence
  Synthetic
gccaagcatttaggtgacactatagatgggggttatatgtgcagagtttcagagctatgctggaaacagc

SEQ ID NO: 55355 - DNA, 70 bp, Artificial Sequence
  Synthetic
gccaagcatttaggtgacactatagcctcagggcctggatctcatgtttcagagctatgctggaaacagc

SEQ ID NO: 55356 - DNA, 70 bp, Artificial Sequence
  Synthetic
gccaagcatttaggtgacactatagcacggaagtgaagattcctggtttcagagctatgctggaaacagc

SEQ ID NO: 55357 - DNA, 70 bp, Artificial Sequence
  Synthetic
gccaagcatttaggtgacactatagctttctaggaattctttggggtttcagagctatgctggaaacagc

SEQ ID NO: 55358 - DNA, 70 bp, Artificial Sequence
  Synthetic
gccaagcatttaggtgacactatagggaccccaggccagctaatggtttcagagctatgctggaaacagc

SEQ ID NO: 55359 - DNA, 70 bp, Artificial Sequence
  Synthetic
gccaagcatttaggtgacactataggctttgctctggtcaaatgcgtttcagagctatgctggaaacagc

SEQ ID NO: 55360 - DNA, 70 bp, Artificial Sequence
  Synthetic
gccaagcatttaggtgacactatagtgtgcagtgggagtcctgaggtttcagagctatgctggaaacagc

SEQ ID NO: 55361 - DNA, 70 bp, Artificial Sequence
  Synthetic
gccaagcatttaggtgacactataggagaagtgaagagagatgtggtttcagagctatgctggaaacagc

SEQ ID NO: 55362 - DNA, 70 bp, Artificial Sequence
  Synthetic
gccaagcatttaggtgacactataggccgcggttcactccctggtgtttcagagctatgctggaaacagc

SEQ ID NO: 55363 - DNA, 70 bp, Artificial Sequence
  Synthetic
gccaagcatttaggtgacactatagcagcaaccctgagtccctaagtttcagagctatgctggaaacagc

SEQ ID NO: 55364 - DNA, 70 bp, Artificial Sequence
  Synthetic
gccaagcatttaggtgacactatagttttggaaagccacttcaatgtttcagagctatgctggaaacagc

SEQ ID NO: 55365 - DNA, 70 bp, Artificial Sequence
  Synthetic
gccaagcatttaggtgacactatagacaggcggtttctgctattcgtttcagagctatgctggaaacagc

SEQ ID NO: 55366 - DNA, 70 bp, Artificial Sequence
  Synthetic
gccaagcatttaggtgacactatagcttgtagaatttctgcatccgtttcagagctatgctggaaacagc

SEQ ID NO: 55367 - DNA, 70 bp, Artificial Sequence
  Synthetic
gccaagcatttaggtgacactataggccccgtgtgatgggctagcgtttcagagctatgctggaaacagc

SEQ ID NO: 55368 - DNA, 70 bp, Artificial Sequence
  Synthetic
gccaagcatttaggtgacactatagaactggatattcttctttccgtttcagagctatgctggaaacagc

SEQ ID NO: 55369 - DNA, 70 bp, Artificial Sequence
  Synthetic
gccaagcatttaggtgacactatagattgagcccccagccctgatgtttcagagctatgctggaaacagc

SEQ ID NO: 55370 - DNA, 70 bp, Artificial Sequence
  Synthetic
gccaagcatttaggtgacactataggccccccaggccacaggttcgtttcagagctatgctggaaacagc

SEQ ID NO: 55371 - DNA, 70 bp, Artificial Sequence
  Synthetic
gccaagcatttaggtgacactatagtgagtgggctcacctggcaggtttcagagctatgctggaaacagc

SEQ ID NO: 55372 - DNA, 70 bp, Artificial Sequence
  Synthetic
gccaagcatttaggtgacactataggggtcaggacccaactcactgtttcagagctatgctggaaacagc

SEQ ID NO: 55373 - DNA, 70 bp, Artificial Sequence
  Synthetic
gccaagcatttaggtgacactatagaggattggggttcaggtttcgtttcagagctatgctggaaacagc

SEQ ID NO: 55374 - DNA, 70 bp, Artificial Sequence
  Synthetic
gccaagcatttaggtgacactataggttggactcaaaagatcgcggtttcagagctatgctggaaacagc

SEQ ID NO: 55375 - DNA, 70 bp, Artificial Sequence
  Synthetic
gccaagcatttaggtgacactatagaaggaagagatggccttaaggtttcagagctatgctggaaacagc

SEQ ID NO: 55376 - DNA, 70 bp, Artificial Sequence
  Synthetic
gccaagcatttaggtgacactataggagagtcctgaggaaatggagtttcagagctatgctggaaacagc

SEQ ID NO: 55377 - DNA, 70 bp, Artificial Sequence
  Synthetic
gccaagcatttaggtgacactatagcacttatattgaagttgggcgtttcagagctatgctggaaacagc

SEQ ID NO: 55378 - DNA, 70 bp, Artificial Sequence
  Synthetic
gccaagcatttaggtgacactatagtcgcatttagacttctccctgtttcagagctatgctggaaacagc

SEQ ID NO: 55379 - DNA, 70 bp, Artificial Sequence
  Synthetic
gccaagcatttaggtgacactatagattggggttcagagcacttcgtttcagagctatgctggaaacagc

SEQ ID NO: 55380 - DNA, 70 bp, Artificial Sequence
  Synthetic
gccaagcatttaggtgacactatagtggagtgtttataggtgtaagtttcagagctatgctggaaacagc

SEQ ID NO: 55381 - DNA, 70 bp, Artificial Sequence
  Synthetic
gccaagcatttaggtgacactatagtccagggtgctcagggcaaggtttcagagctatgctggaaacagc

SEQ ID NO: 55382 - DNA, 70 bp, Artificial Sequence
  Synthetic
gccaagcatttaggtgacactatagaagccaacactactgactttgtttcagagctatgctggaaacagc

SEQ ID NO: 55383 - DNA, 70 bp, Artificial Sequence
  Synthetic
gccaagcatttaggtgacactatagatctttctcaccaaggagaggtttcagagctatgctggaaacagc

SEQ ID NO: 55384 - DNA, 70 bp, Artificial Sequence
  Synthetic
gccaagcatttaggtgacactatagccttatttctacatccttccgtttcagagctatgctggaaacagc

SEQ ID NO: 55385 - DNA, 70 bp, Artificial Sequence
  Synthetic
gccaagcatttaggtgacactatagtcattctgacttcagaacttgtttcagagctatgctggaaacagc

SEQ ID NO: 55386 - DNA, 70 bp, Artificial Sequence
  Synthetic
gccaagcatttaggtgacactatagtacttccagcagtgtgactagtttcagagctatgctggaaacagc

SEQ ID NO: 55387 - DNA, 70 bp, Artificial Sequence
  Synthetic
gccaagcatttaggtgacactatagccccagtgaggtcagcgattgtttcagagctatgctggaaacagc

SEQ ID NO: 55388 - DNA, 70 bp, Artificial Sequence
  Synthetic
gccaagcatttaggtgacactataggtgtctggtgactgaagtacgtttcagagctatgctggaaacagc

SEQ ID NO: 55389 - DNA, 70 bp, Artificial Sequence
  Synthetic
gccaagcatttaggtgacactatagcgttggaaaacttcttggaagtttcagagctatgctggaaacagc

SEQ ID NO: 55390 - DNA, 70 bp, Artificial Sequence
  Synthetic
gccaagcatttaggtgacactatagtccgaaaatactttaatgcggtttcagagctatgctggaaacagc

SEQ ID NO: 55391 - DNA, 70 bp, Artificial Sequence
  Synthetic
gccaagcatttaggtgacactatagcacatacatgagggtctcttgtttcagagctatgctggaaacagc

SEQ ID NO: 55392 - DNA, 70 bp, Artificial Sequence
  Synthetic
gccaagcatttaggtgacactatagttggtgtaatgaacaccgaggtttcagagctatgctggaaacagc

SEQ ID NO: 55393 - DNA, 70 bp, Artificial Sequence
  Synthetic
gccaagcatttaggtgacactataggacttcaatttccgtctcacgtttcagagctatgctggaaacagc

SEQ ID NO: 55394 - DNA, 70 bp, Artificial Sequence
  Synthetic
gccaagcatttaggtgacactataggtcaaaacacagaatcctccgtttcagagctatgctggaaacagc

SEQ ID NO: 55395 - DNA, 70 bp, Artificial Sequence
  Synthetic
gccaagcatttaggtgacactatagtggagccaacctatttatgtgtttcagagctatgctggaaacagc

SEQ ID NO: 55396 - DNA, 70 bp, Artificial Sequence
  Synthetic
gccaagcatttaggtgacactataggctcttcggcaaatgtagcagtttcagagctatgctggaaacagc

SEQ ID NO: 55397 - DNA, 70 bp, Artificial Sequence
  Synthetic
gccaagcatttaggtgacactatagcacggcaacttctgcctcctgtttcagagctatgctggaaacagc

SEQ ID NO: 55398 - DNA, 70 bp, Artificial Sequence
  Synthetic
gccaagcatttaggtgacactatagctacttcttccccagatagcgtttcagagctatgctggaaacagc

SEQ ID NO: 55399 - DNA, 70 bp, Artificial Sequence
  Synthetic
gccaagcatttaggtgacactataggtggaagctgcgggctctgagtttcagagctatgctggaaacagc

SEQ ID NO: 55400 - DNA, 70 bp, Artificial Sequence
  Synthetic
gccaagcatttaggtgacactataggcggctacatgcctcagtgagtttcagagctatgctggaaacagc

SEQ ID NO: 55401 - DNA, 70 bp, Artificial Sequence
  Synthetic
gccaagcatttaggtgacactatagactgttgaactgcactggccgtttcagagctatgctggaaacagc

SEQ ID NO: 55402 - DNA, 70 bp, Artificial Sequence
  Synthetic
gccaagcatttaggtgacactatagagcccaaccaacaaagagttgtttcagagctatgctggaaacagc

SEQ ID NO: 55403 - DNA, 70 bp, Artificial Sequence
  Synthetic
gccaagcatttaggtgacactatagggtcagcatcgatcaattatgtttcagagctatgctggaaacagc

SEQ ID NO: 55404 - DNA, 70 bp, Artificial Sequence
  Synthetic
gccaagcatttaggtgacactatagctgggtttcttacacttcacgtttcagagctatgctggaaacagc

SEQ ID NO: 55405 - DNA, 70 bp, Artificial Sequence
  Synthetic
gccaagcatttaggtgacactataggaaaagatgagagggatgaggtttcagagctatgctggaaacagc

SEQ ID NO: 55406 - DNA, 70 bp, Artificial Sequence
  Synthetic
gccaagcatttaggtgacactatagggctcggtcctggacattctgtttcagagctatgctggaaacagc

SEQ ID NO: 55407 - DNA, 70 bp, Artificial Sequence
  Synthetic
gccaagcatttaggtgacactataggtcctggctcaacagcacacgtttcagagctatgctggaaacagc

SEQ ID NO: 55408 - DNA, 70 bp, Artificial Sequence
  Synthetic
gccaagcatttaggtgacactatagctctcatagtggaaggagtggtttcagagctatgctggaaacagc

SEQ ID NO: 55409 - DNA, 70 bp, Artificial Sequence
  Synthetic
gccaagcatttaggtgacactataggttgacaacatcagaccacagtttcagagctatgctggaaacagc

SEQ ID NO: 55410 - DNA, 70 bp, Artificial Sequence
  Synthetic
gccaagcatttaggtgacactatagagaagaaagcatggaaactcgtttcagagctatgctggaaacagc

SEQ ID NO: 55411 - DNA, 70 bp, Artificial Sequence
  Synthetic
gccaagcatttaggtgacactataggctacggctatcatgattttgtttcagagctatgctggaaacagc

SEQ ID NO: 55412 - DNA, 70 bp, Artificial Sequence
  Synthetic
gccaagcatttaggtgacactatagccgcgggggcttatctgtacgtttcagagctatgctggaaacagc

SEQ ID NO: 55413 - DNA, 70 bp, Artificial Sequence
  Synthetic
gccaagcatttaggtgacactatagggaggcaactcggcgacagcgtttcagagctatgctggaaacagc

SEQ ID NO: 55414 - DNA, 70 bp, Artificial Sequence
  Synthetic
gccaagcatttaggtgacactatagtgagaagatgcaggacaagtgtttcagagctatgctggaaacagc

SEQ ID NO: 55415 - DNA, 70 bp, Artificial Sequence
  Synthetic
gccaagcatttaggtgacactatagggtgcggatagggcactgaggtttcagagctatgctggaaacagc

SEQ ID NO: 55416 - DNA, 70 bp, Artificial Sequence
  Synthetic
gccaagcatttaggtgacactataggatggctccattgctgtatagtttcagagctatgctggaaacagc

SEQ ID NO: 55417 - DNA, 70 bp, Artificial Sequence
  Synthetic
gccaagcatttaggtgacactatagtcagaaaatctgtggccattgtttcagagctatgctggaaacagc

SEQ ID NO: 55418 - DNA, 70 bp, Artificial Sequence
  Synthetic
gccaagcatttaggtgacactatagccgtggtgacattgtatcatgtttcagagctatgctggaaacagc

SEQ ID NO: 55419 - DNA, 70 bp, Artificial Sequence
  Synthetic
gccaagcatttaggtgacactatagctcttgaaggagatattgtcgtttcagagctatgctggaaacagc

SEQ ID NO: 55420 - DNA, 70 bp, Artificial Sequence
  Synthetic
gccaagcatttaggtgacactatagcttaccagtacagagagaaggtttcagagctatgctggaaacagc

SEQ ID NO: 55421 - DNA, 70 bp, Artificial Sequence
  Synthetic
gccaagcatttaggtgacactataggagatgggagaaaactgaaagtttcagagctatgctggaaacagc

SEQ ID NO: 55422 - DNA, 70 bp, Artificial Sequence
  Synthetic
gccaagcatttaggtgacactatagaatcttcctaaacctcactcgtttcagagctatgctggaaacagc

SEQ ID NO: 55423 - DNA, 70 bp, Artificial Sequence
  Synthetic
gccaagcatttaggtgacactatagacttcgatctggaagcctaggtttcagagctatgctggaaacagc

SEQ ID NO: 55424 - DNA, 70 bp, Artificial Sequence
  Synthetic
gccaagcatttaggtgacactataggagtggtgagtgtgctcactgtttcagagctatgctggaaacagc

SEQ ID NO: 55425 - DNA, 70 bp, Artificial Sequence
  Synthetic
gccaagcatttaggtgacactatagtcttcgtcgtctcgttgcaagtttcagagctatgctggaaacagc

SEQ ID NO: 55426 - DNA, 70 bp, Artificial Sequence
  Synthetic
gccaagcatttaggtgacactatagtgaagctggtggcgtgctaagtttcagagctatgctggaaacagc

SEQ ID NO: 55427 - DNA, 70 bp, Artificial Sequence
  Synthetic
gccaagcatttaggtgacactatagacagacgattaactatgggcgtttcagagctatgctggaaacagc

SEQ ID NO: 55428 - DNA, 70 bp, Artificial Sequence
  Synthetic
gccaagcatttaggtgacactataggaggagtcatctaaggctttgtttcagagctatgctggaaacagc

SEQ ID NO: 55429 - DNA, 70 bp, Artificial Sequence
  Synthetic
gccaagcatttaggtgacactatagctcccagatctagaaaagacgtttcagagctatgctggaaacagc

SEQ ID NO: 55430 - DNA, 70 bp, Artificial Sequence
  Synthetic
gccaagcatttaggtgacactatagtacgaaaagcggctgtactggtttcagagctatgctggaaacagc

SEQ ID NO: 55431 - DNA, 70 bp, Artificial Sequence
  Synthetic
gccaagcatttaggtgacactataggagaagcggcttttctgaaagtttcagagctatgctggaaacagc

SEQ ID NO: 55432 - DNA, 70 bp, Artificial Sequence
  Synthetic
gccaagcatttaggtgacactatagtttaaccatcaagattgggagtttcagagctatgctggaaacagc

SEQ ID NO: 55433 - DNA, 70 bp, Artificial Sequence
  Synthetic
gccaagcatttaggtgacactatagctcacaaaagctgcaaactcgtttcagagctatgctggaaacagc

SEQ ID NO: 55434 - DNA, 70 bp, Artificial Sequence
  Synthetic
gccaagcatttaggtgacactatagcttcaaaactttcccctatcgtttcagagctatgctggaaacagc

SEQ ID NO: 55435 - DNA, 70 bp, Artificial Sequence
  Synthetic
gccaagcatttaggtgacactataggggtggaagggagagttaccgtttcagagctatgctggaaacagc

SEQ ID NO: 55436 - DNA, 70 bp, Artificial Sequence
  Synthetic
gccaagcatttaggtgacactatagcggagggcttcaacgactccgtttcagagctatgctggaaacagc

SEQ ID NO: 55437 - DNA, 70 bp, Artificial Sequence
  Synthetic
gccaagcatttaggtgacactatagttggcagcgtctgaagagtagtttcagagctatgctggaaacagc

SEQ ID NO: 55438 - DNA, 70 bp, Artificial Sequence
  Synthetic
gccaagcatttaggtgacactatagtacagcctgaagaagcactggtttcagagctatgctggaaacagc

SEQ ID NO: 55439 - DNA, 70 bp, Artificial Sequence
  Synthetic
gccaagcatttaggtgacactataggtggcctgggctctctcactgtttcagagctatgctggaaacagc

SEQ ID NO: 55440 - DNA, 70 bp, Artificial Sequence
  Synthetic
gccaagcatttaggtgacactatagaaactgtgtgtgatccagtagtttcagagctatgctggaaacagc

SEQ ID NO: 55441 - DNA, 70 bp, Artificial Sequence
  Synthetic
gccaagcatttaggtgacactatagctacagtggggactcaccgcgtttcagagctatgctggaaacagc

SEQ ID NO: 55442 - DNA, 70 bp, Artificial Sequence
  Synthetic
gccaagcatttaggtgacactatagaaaaagagagggcttacaacgtttcagagctatgctggaaacagc

SEQ ID NO: 55443 - DNA, 70 bp, Artificial Sequence
  Synthetic
gccaagcatttaggtgacactatagtggtattgcccaaagtgcaggtttcagagctatgctggaaacagc

SEQ ID NO: 55444 - DNA, 70 bp, Artificial Sequence
  Synthetic
gccaagcatttaggtgacactataggaggcagcagacacaaataagtttcagagctatgctggaaacagc

SEQ ID NO: 55445 - DNA, 70 bp, Artificial Sequence
  Synthetic
gccaagcatttaggtgacactatagtgcagatgagaaggttcagtgtttcagagctatgctggaaacagc

SEQ ID NO: 55446 - DNA, 70 bp, Artificial Sequence
  Synthetic
gccaagcatttaggtgacactatagcttggttgtcagccccacacgtttcagagctatgctggaaacagc

SEQ ID NO: 55447 - DNA, 70 bp, Artificial Sequence
  Synthetic
gccaagcatttaggtgacactatagtctatttcttcttccgttctgtttcagagctatgctggaaacagc

SEQ ID NO: 55448 - DNA, 70 bp, Artificial Sequence
  Synthetic
gccaagcatttaggtgacactatagaaagaggaagaagaagtagggtttcagagctatgctggaaacagc

SEQ ID NO: 55449 - DNA, 70 bp, Artificial Sequence
  Synthetic
gccaagcatttaggtgacactataggaccttaccacgaaacccaagtttcagagctatgctggaaacagc

SEQ ID NO: 55450 - DNA, 70 bp, Artificial Sequence
  Synthetic
gccaagcatttaggtgacactatagtgggcagacgggtcatcctggtttcagagctatgctggaaacagc

SEQ ID NO: 55451 - DNA, 70 bp, Artificial Sequence
  Synthetic
gccaagcatttaggtgacactatagagcactgtgcttgtatctaagtttcagagctatgctggaaacagc

SEQ ID NO: 55452 - DNA, 70 bp, Artificial Sequence
  Synthetic
gccaagcatttaggtgacactatagacatgatcgtggaggagtgtgtttcagagctatgctggaaacagc

SEQ ID NO: 55453 - DNA, 70 bp, Artificial Sequence
  Synthetic
gccaagcatttaggtgacactatagaacatgattgtggaggagtggtttcagagctatgctggaaacagc

SEQ ID NO: 55454 - DNA, 70 bp, Artificial Sequence
  Synthetic
gccaagcatttaggtgacactatagcatagactaactgcacccacgtttcagagctatgctggaaacagc

SEQ ID NO: 55455 - DNA, 70 bp, Artificial Sequence
  Synthetic
gccaagcatttaggtgacactatagctcttgctagctgcagccacgtttcagagctatgctggaaacagc

SEQ ID NO: 55456 - DNA, 70 bp, Artificial Sequence
  Synthetic
gccaagcatttaggtgacactatagcagtcaaacttgctaggagtgtttcagagctatgctggaaacagc

SEQ ID NO: 55457 - DNA, 70 bp, Artificial Sequence
  Synthetic
gccaagcatttaggtgacactataggttttcttcattctgggtcagtttcagagctatgctggaaacagc

SEQ ID NO: 55458 - DNA, 70 bp, Artificial Sequence
  Synthetic
gccaagcatttaggtgacactataggccctcctggctcagggcccgtttcagagctatgctggaaacagc

SEQ ID NO: 55459 - DNA, 70 bp, Artificial Sequence
  Synthetic
gccaagcatttaggtgacactataggcaccaacccctctggaggagtttcagagctatgctggaaacagc

SEQ ID NO: 55460 - DNA, 70 bp, Artificial Sequence
  Synthetic
gccaagcatttaggtgacactatagtccccccttttggctacgtagtttcagagctatgctggaaacagc

SEQ ID NO: 55461 - DNA, 70 bp, Artificial Sequence
  Synthetic
gccaagcatttaggtgacactatagggctcagggaacgatgctcggtttcagagctatgctggaaacagc

SEQ ID NO: 55462 - DNA, 70 bp, Artificial Sequence
  Synthetic
gccaagcatttaggtgacactatagcctttccctcccctaactgagtttcagagctatgctggaaacagc

SEQ ID NO: 55463 - DNA, 70 bp, Artificial Sequence
  Synthetic
gccaagcatttaggtgacactataggggcagggagtccagttagggtttcagagctatgctggaaacagc

SEQ ID NO: 55464 - DNA, 70 bp, Artificial Sequence
  Synthetic
gccaagcatttaggtgacactataggcgtgatgtcacggtcactcgtttcagagctatgctggaaacagc

SEQ ID NO: 55465 - DNA, 70 bp, Artificial Sequence
  Synthetic
gccaagcatttaggtgacactatagctgcagagacgcatacctaggtttcagagctatgctggaaacagc

SEQ ID NO: 55466 - DNA, 70 bp, Artificial Sequence
  Synthetic
gccaagcatttaggtgacactatagaggcctcccgaagggacttagtttcagagctatgctggaaacagc

SEQ ID NO: 55467 - DNA, 70 bp, Artificial Sequence
  Synthetic
gccaagcatttaggtgacactatagtgcaacgcaatttggtcaccgtttcagagctatgctggaaacagc

SEQ ID NO: 55468 - DNA, 70 bp, Artificial Sequence
  Synthetic
gccaagcatttaggtgacactatagagacctccagaggggacttagtttcagagctatgctggaaacagc

SEQ ID NO: 55469 - DNA, 70 bp, Artificial Sequence
  Synthetic
gccaagcatttaggtgacactatagtgtgtggcttattttaagtcgtttcagagctatgctggaaacagc

SEQ ID NO: 55470 - DNA, 70 bp, Artificial Sequence
  Synthetic
gccaagcatttaggtgacactatagtgttgtgtcgtgcagtgacggtttcagagctatgctggaaacagc

SEQ ID NO: 55471 - DNA, 70 bp, Artificial Sequence
  Synthetic
gccaagcatttaggtgacactataggaggagagagaggctcagaggtttcagagctatgctggaaacagc

SEQ ID NO: 55472 - DNA, 70 bp, Artificial Sequence
  Synthetic
gccaagcatttaggtgacactatagggccaccagggcctctaggcgtttcagagctatgctggaaacagc

SEQ ID NO: 55473 - DNA, 70 bp, Artificial Sequence
  Synthetic
gccaagcatttaggtgacactatagacttcaagaaacggagcagagtttcagagctatgctggaaacagc

SEQ ID NO: 55474 - DNA, 70 bp, Artificial Sequence
  Synthetic
gccaagcatttaggtgacactatagaaatctgaattatccgtgtcgtttcagagctatgctggaaacagc

SEQ ID NO: 55475 - DNA, 70 bp, Artificial Sequence
  Synthetic
gccaagcatttaggtgacactatagttgcacttgggaagaagtgagtttcagagctatgctggaaacagc

SEQ ID NO: 55476 - DNA, 70 bp, Artificial Sequence
  Synthetic
gccaagcatttaggtgacactatagaagggggcctggggccctgagtttcagagctatgctggaaacagc

SEQ ID NO: 55477 - DNA, 70 bp, Artificial Sequence
  Synthetic
gccaagcatttaggtgacactatagcccatcctggctcagatctggtttcagagctatgctggaaacagc

SEQ ID NO: 55478 - DNA, 70 bp, Artificial Sequence
  Synthetic
gccaagcatttaggtgacactataggctatcacttgctgagctgcgtttcagagctatgctggaaacagc

SEQ ID NO: 55479 - DNA, 70 bp, Artificial Sequence
  Synthetic
gccaagcatttaggtgacactatagagttgcagtagttctccagcgtttcagagctatgctggaaacagc

SEQ ID NO: 55480 - DNA, 70 bp, Artificial Sequence
  Synthetic
gccaagcatttaggtgacactatagccccagcgctcccagaactggtttcagagctatgctggaaacagc

SEQ ID NO: 55481 - DNA, 70 bp, Artificial Sequence
  Synthetic
gccaagcatttaggtgacactatagcttactctgcagcaacatgggtttcagagctatgctggaaacagc

SEQ ID NO: 55482 - DNA, 70 bp, Artificial Sequence
  Synthetic
gccaagcatttaggtgacactatagtcctgctgtggtttttatttgtttcagagctatgctggaaacagc

SEQ ID NO: 55483 - DNA, 70 bp, Artificial Sequence
  Synthetic
gccaagcatttaggtgacactatagggcgtcacggtggggaacatgtttcagagctatgctggaaacagc

SEQ ID NO: 55484 - DNA, 70 bp, Artificial Sequence
  Synthetic
gccaagcatttaggtgacactatagttgaagactcaatcactatggtttcagagctatgctggaaacagc

SEQ ID NO: 55485 - DNA, 70 bp, Artificial Sequence
  Synthetic
gccaagcatttaggtgacactatagtttggaagaaaatctgactggtttcagagctatgctggaaacagc

SEQ ID NO: 55486 - DNA, 70 bp, Artificial Sequence
  Synthetic
gccaagcatttaggtgacactatagaatctcatcaggaatgaagagtttcagagctatgctggaaacagc

SEQ ID NO: 55487 - DNA, 70 bp, Artificial Sequence
  Synthetic
gccaagcatttaggtgacactatagtatcgcagaaaaatctcatcgtttcagagctatgctggaaacagc

SEQ ID NO: 55488 - DNA, 70 bp, Artificial Sequence
  Synthetic
gccaagcatttaggtgacactatagagtagggacagagggtcagcgtttcagagctatgctggaaacagc

SEQ ID NO: 55489 - DNA, 70 bp, Artificial Sequence
  Synthetic
gccaagcatttaggtgacactataggcacccaaggaggaatcagtgtttcagagctatgctggaaacagc

SEQ ID NO: 55490 - DNA, 70 bp, Artificial Sequence
  Synthetic
gccaagcatttaggtgacactatagtgtgaagtaatttgtgacgagtttcagagctatgctggaaacagc

SEQ ID NO: 55491 - DNA, 70 bp, Artificial Sequence
  Synthetic
gccaagcatttaggtgacactatagaagagcactcaaatcagtcagtttcagagctatgctggaaacagc

SEQ ID NO: 55492 - DNA, 70 bp, Artificial Sequence
  Synthetic
gccaagcatttaggtgacactatagtcagaaaagtgttgtcttacgtttcagagctatgctggaaacagc

SEQ ID NO: 55493 - DNA, 70 bp, Artificial Sequence
  Synthetic
gccaagcatttaggtgacactatagggtggagggcgcgctctagcgtttcagagctatgctggaaacagc

SEQ ID NO: 55494 - DNA, 70 bp, Artificial Sequence
  Synthetic
gccaagcatttaggtgacactatagcactgcggcctggctgctgagtttcagagctatgctggaaacagc

SEQ ID NO: 55495 - DNA, 70 bp, Artificial Sequence
  Synthetic
gccaagcatttaggtgacactatagcacggtaggcactgttaggagtttcagagctatgctggaaacagc

SEQ ID NO: 55496 - DNA, 70 bp, Artificial Sequence
  Synthetic
gccaagcatttaggtgacactataggccctcaaaatgggggtccagtttcagagctatgctggaaacagc

SEQ ID NO: 55497 - DNA, 70 bp, Artificial Sequence
  Synthetic
gccaagcatttaggtgacactataggctgccacaggctcacatcagtttcagagctatgctggaaacagc

SEQ ID NO: 55498 - DNA, 70 bp, Artificial Sequence
  Synthetic
gccaagcatttaggtgacactatagccttcagactctgacctgaggtttcagagctatgctggaaacagc

SEQ ID NO: 55499 - DNA, 70 bp, Artificial Sequence
  Synthetic
gccaagcatttaggtgacactatagggtgagttgccggcctcagcgtttcagagctatgctggaaacagc

SEQ ID NO: 55500 - DNA, 70 bp, Artificial Sequence
  Synthetic
gccaagcatttaggtgacactatagtgctatgaagcgattacagagtttcagagctatgctggaaacagc

SEQ ID NO: 55501 - DNA, 70 bp, Artificial Sequence
  Synthetic
gccaagcatttaggtgacactatagttcaagtcactcttcactgcgtttcagagctatgctggaaacagc

SEQ ID NO: 55502 - DNA, 70 bp, Artificial Sequence
  Synthetic
gccaagcatttaggtgacactatagctttgcacacggacttctctgtttcagagctatgctggaaacagc

SEQ ID NO: 55503 - DNA, 70 bp, Artificial Sequence
  Synthetic
gccaagcatttaggtgacactatagcagtgacagagctgtacatcgtttcagagctatgctggaaacagc

SEQ ID NO: 55504 - DNA, 70 bp, Artificial Sequence
  Synthetic
gccaagcatttaggtgacactataggtgggctctgacagtgactggtttcagagctatgctggaaacagc

SEQ ID NO: 55505 - DNA, 70 bp, Artificial Sequence
  Synthetic
gccaagcatttaggtgacactatagcccaaacctgcacggcgctagtttcagagctatgctggaaacagc

SEQ ID NO: 55506 - DNA, 70 bp, Artificial Sequence
  Synthetic
gccaagcatttaggtgacactatagcgtccactctccttcgacaggtttcagagctatgctggaaacagc

SEQ ID NO: 55507 - DNA, 70 bp, Artificial Sequence
  Synthetic
gccaagcatttaggtgacactatagagaacaactggagaacttctgtttcagagctatgctggaaacagc

SEQ ID NO: 55508 - DNA, 70 bp, Artificial Sequence
  Synthetic
gccaagcatttaggtgacactatagatagacaactatgggcaggtgtttcagagctatgctggaaacagc

SEQ ID NO: 55509 - DNA, 70 bp, Artificial Sequence
  Synthetic
gccaagcatttaggtgacactatagcatgcaagaacaaatgtcaggtttcagagctatgctggaaacagc

SEQ ID NO: 55510 - DNA, 70 bp, Artificial Sequence
  Synthetic
gccaagcatttaggtgacactatagtgtgactaatgttgttgtgagtttcagagctatgctggaaacagc

SEQ ID NO: 55511 - DNA, 70 bp, Artificial Sequence
  Synthetic
gccaagcatttaggtgacactatagccatggttaaaaccgtgtgtgtttcagagctatgctggaaacagc

SEQ ID NO: 55512 - DNA, 70 bp, Artificial Sequence
  Synthetic
gccaagcatttaggtgacactatagagtaaagttttgccattgctgtttcagagctatgctggaaacagc

SEQ ID NO: 55513 - DNA, 70 bp, Artificial Sequence
  Synthetic
gccaagcatttaggtgacactatagttcttacagaagttctgagtgtttcagagctatgctggaaacagc

SEQ ID NO: 55514 - DNA, 70 bp, Artificial Sequence
  Synthetic
gccaagcatttaggtgacactatagatcaagaaagcacagctacagtttcagagctatgctggaaacagc

SEQ ID NO: 55515 - DNA, 70 bp, Artificial Sequence
  Synthetic
gccaagcatttaggtgacactatagttggctgagtagctgattgcgtttcagagctatgctggaaacagc

SEQ ID NO: 55516 - DNA, 70 bp, Artificial Sequence
  Synthetic
gccaagcatttaggtgacactataggggcccagaacagggcctacgtttcagagctatgctggaaacagc

SEQ ID NO: 55517 - DNA, 70 bp, Artificial Sequence
  Synthetic
gccaagcatttaggtgacactatagagagataagtgaggagagtggtttcagagctatgctggaaacagc

SEQ ID NO: 55518 - DNA, 70 bp, Artificial Sequence
  Synthetic
gccaagcatttaggtgacactatagcagaattgagcaatcttaccgtttcagagctatgctggaaacagc

SEQ ID NO: 55519 - DNA, 70 bp, Artificial Sequence
  Synthetic
gccaagcatttaggtgacactatagcctgtggccacagggaagtggtttcagagctatgctggaaacagc

SEQ ID NO: 55520 - DNA, 70 bp, Artificial Sequence
  Synthetic
gccaagcatttaggtgacactatagtcaggtgggggcgtttcagcgtttcagagctatgctggaaacagc

SEQ ID NO: 55521 - DNA, 70 bp, Artificial Sequence
  Synthetic
gccaagcatttaggtgacactatagggaagtttcattctccctctgtttcagagctatgctggaaacagc

SEQ ID NO: 55522 - DNA, 70 bp, Artificial Sequence
  Synthetic
gccaagcatttaggtgacactatagaaccctgactttgtctcaaagtttcagagctatgctggaaacagc

SEQ ID NO: 55523 - DNA, 70 bp, Artificial Sequence
  Synthetic
gccaagcatttaggtgacactatagcctagcaacacaatagatgagtttcagagctatgctggaaacagc

SEQ ID NO: 55524 - DNA, 70 bp, Artificial Sequence
  Synthetic
gccaagcatttaggtgacactatagcagctacaggagtttttgcagtttcagagctatgctggaaacagc

SEQ ID NO: 55525 - DNA, 70 bp, Artificial Sequence
  Synthetic
gccaagcatttaggtgacactatagttacacagctgactactgaggtttcagagctatgctggaaacagc

SEQ ID NO: 55526 - DNA, 70 bp, Artificial Sequence
  Synthetic
gccaagcatttaggtgacactatagtgcagcctgcagtctaggaggtttcagagctatgctggaaacagc

SEQ ID NO: 55527 - DNA, 70 bp, Artificial Sequence
  Synthetic
gccaagcatttaggtgacactataggctcctgaactctgcgtgaagtttcagagctatgctggaaacagc

SEQ ID NO: 55528 - DNA, 70 bp, Artificial Sequence
  Synthetic
gccaagcatttaggtgacactataggagataactcaattcatcccgtttcagagctatgctggaaacagc

SEQ ID NO: 55529 - DNA, 70 bp, Artificial Sequence
  Synthetic
gccaagcatttaggtgacactatagctgtgcccagcaacaactgagtttcagagctatgctggaaacagc

SEQ ID NO: 55530 - DNA, 70 bp, Artificial Sequence
  Synthetic
gccaagcatttaggtgacactatagcagaccatcggcatctaaaagtttcagagctatgctggaaacagc

SEQ ID NO: 55531 - DNA, 70 bp, Artificial Sequence
  Synthetic
gccaagcatttaggtgacactatagatcacaagactctaacaaaggtttcagagctatgctggaaacagc

SEQ ID NO: 55532 - DNA, 70 bp, Artificial Sequence
  Synthetic
gccaagcatttaggtgacactatagatcaccagtcgttgtgaagggtttcagagctatgctggaaacagc

SEQ ID NO: 55533 - DNA, 70 bp, Artificial Sequence
  Synthetic
gccaagcatttaggtgacactatagagggaaagagttagaccttggtttcagagctatgctggaaacagc

SEQ ID NO: 55534 - DNA, 70 bp, Artificial Sequence
  Synthetic
gccaagcatttaggtgacactatagaggcaaaggacaaagggaaagtttcagagctatgctggaaacagc

SEQ ID NO: 55535 - DNA, 70 bp, Artificial Sequence
  Synthetic
gccaagcatttaggtgacactatagagaagaagaaaaggaagtgagtttcagagctatgctggaaacagc

SEQ ID NO: 55536 - DNA, 70 bp, Artificial Sequence
  Synthetic
gccaagcatttaggtgacactatagcttagggttactcactaagggtttcagagctatgctggaaacagc

SEQ ID NO: 55537 - DNA, 70 bp, Artificial Sequence
  Synthetic
gccaagcatttaggtgacactatagtggcttcctagggtctagccgtttcagagctatgctggaaacagc

SEQ ID NO: 55538 - DNA, 70 bp, Artificial Sequence
  Synthetic
gccaagcatttaggtgacactatagaaaggcaaggagaagggcaagtttcagagctatgctggaaacagc

SEQ ID NO: 55539 - DNA, 70 bp, Artificial Sequence
  Synthetic
gccaagcatttaggtgacactatagacagtgacggggacctaaacgtttcagagctatgctggaaacagc

SEQ ID NO: 55540 - DNA, 70 bp, Artificial Sequence
  Synthetic
gccaagcatttaggtgacactatagtaaggcgacgcttagttcaggtttcagagctatgctggaaacagc

SEQ ID NO: 55541 - DNA, 70 bp, Artificial Sequence
  Synthetic
gccaagcatttaggtgacactatagatacactctgtcacaatgcagtttcagagctatgctggaaacagc

SEQ ID NO: 55542 - DNA, 70 bp, Artificial Sequence
  Synthetic
gccaagcatttaggtgacactatagttgagatcatcaactcctaagtttcagagctatgctggaaacagc

SEQ ID NO: 55543 - DNA, 70 bp, Artificial Sequence
  Synthetic
gccaagcatttaggtgacactatagcccaggcctttcagattgatgtttcagagctatgctggaaacagc

SEQ ID NO: 55544 - DNA, 70 bp, Artificial Sequence
  Synthetic
gccaagcatttaggtgacactatagagacctggtcattcttttaagtttcagagctatgctggaaacagc

SEQ ID NO: 55545 - DNA, 70 bp, Artificial Sequence
  Synthetic
gccaagcatttaggtgacactatagatcgaaatcctcatgacctagtttcagagctatgctggaaacagc

SEQ ID NO: 55546 - DNA, 70 bp, Artificial Sequence
  Synthetic
gccaagcatttaggtgacactatagaaaggcaaggataagaggaggtttcagagctatgctggaaacagc

SEQ ID NO: 55547 - DNA, 70 bp, Artificial Sequence
  Synthetic
gccaagcatttaggtgacactatagacagctcaattgccatctccgtttcagagctatgctggaaacagc

SEQ ID NO: 55548 - DNA, 70 bp, Artificial Sequence
  Synthetic
gccaagcatttaggtgacactataggctgctgtaaatgcgaactagtttcagagctatgctggaaacagc

SEQ ID NO: 55549 - DNA, 70 bp, Artificial Sequence
  Synthetic
gccaagcatttaggtgacactatagtaggtgctgatatttcttgagtttcagagctatgctggaaacagc

SEQ ID NO: 55550 - DNA, 70 bp, Artificial Sequence
  Synthetic
gccaagcatttaggtgacactatagtcaatcaaggagccataatggtttcagagctatgctggaaacagc

SEQ ID NO: 55551 - DNA, 70 bp, Artificial Sequence
  Synthetic
gccaagcatttaggtgacactatagtgtattccaggatcatttctgtttcagagctatgctggaaacagc

SEQ ID NO: 55552 - DNA, 70 bp, Artificial Sequence
  Synthetic
gccaagcatttaggtgacactatagtaaacttgaggtccattcacgtttcagagctatgctggaaacagc

SEQ ID NO: 55553 - DNA, 70 bp, Artificial Sequence
  Synthetic
gccaagcatttaggtgacactatagtttcagttgaatgtcaagtcgtttcagagctatgctggaaacagc

SEQ ID NO: 55554 - DNA, 70 bp, Artificial Sequence
  Synthetic
gccaagcatttaggtgacactatagaccagcaagtcaaaattttcgtttcagagctatgctggaaacagc

SEQ ID NO: 55555 - DNA, 70 bp, Artificial Sequence
  Synthetic
gccaagcatttaggtgacactatagggaattttcatcttggctgcgtttcagagctatgctggaaacagc

SEQ ID NO: 55556 - DNA, 70 bp, Artificial Sequence
  Synthetic
gccaagcatttaggtgacactatagttttgttgagaaggaagatcgtttcagagctatgctggaaacagc

SEQ ID NO: 55557 - DNA, 70 bp, Artificial Sequence
  Synthetic
gccaagcatttaggtgacactatagctgctgaacaagaagttctagtttcagagctatgctggaaacagc

SEQ ID NO: 55558 - DNA, 70 bp, Artificial Sequence
  Synthetic
gccaagcatttaggtgacactatagtcctcaacaagaagtttttggtttcagagctatgctggaaacagc

SEQ ID NO: 55559 - DNA, 70 bp, Artificial Sequence
  Synthetic
gccaagcatttaggtgacactatagcacaattgtgctgatgccgcgtttcagagctatgctggaaacagc

SEQ ID NO: 55560 - DNA, 70 bp, Artificial Sequence
  Synthetic
gccaagcatttaggtgacactatagcatgtgaggactgctaatgagtttcagagctatgctggaaacagc

SEQ ID NO: 55561 - DNA, 70 bp, Artificial Sequence
  Synthetic
gccaagcatttaggtgacactataggcttaggagcacagcactgagtttcagagctatgctggaaacagc

SEQ ID NO: 55562 - DNA, 70 bp, Artificial Sequence
  Synthetic
gccaagcatttaggtgacactatagtctctccattcatcagaccagtttcagagctatgctggaaacagc

SEQ ID NO: 55563 - DNA, 70 bp, Artificial Sequence
  Synthetic
gccaagcatttaggtgacactatagctgcgagacctctctgatgcgtttcagagctatgctggaaacagc

SEQ ID NO: 55564 - DNA, 70 bp, Artificial Sequence
  Synthetic
gccaagcatttaggtgacactatagtttacagagcactatgggaggtttcagagctatgctggaaacagc

SEQ ID NO: 55565 - DNA, 70 bp, Artificial Sequence
  Synthetic
gccaagcatttaggtgacactatagggtggggcagagtctacaccgtttcagagctatgctggaaacagc

SEQ ID NO: 55566 - DNA, 70 bp, Artificial Sequence
  Synthetic
gccaagcatttaggtgacactatagaattggtaaaatggtgagtcgtttcagagctatgctggaaacagc

SEQ ID NO: 55567 - DNA, 70 bp, Artificial Sequence
  Synthetic
gccaagcatttaggtgacactatagtactcctggatcacctaatggtttcagagctatgctggaaacagc

SEQ ID NO: 55568 - DNA, 70 bp, Artificial Sequence
  Synthetic
gccaagcatttaggtgacactataggcctggaacaggacaggcaggtttcagagctatgctggaaacagc

SEQ ID NO: 55569 - DNA, 70 bp, Artificial Sequence
  Synthetic
gccaagcatttaggtgacactatagagttaatgaacttgagagtcgtttcagagctatgctggaaacagc

SEQ ID NO: 55570 - DNA, 70 bp, Artificial Sequence
  Synthetic
gccaagcatttaggtgacactatagagctgtgttccggtcatcaggtttcagagctatgctggaaacagc

SEQ ID NO: 55571 - DNA, 70 bp, Artificial Sequence
  Synthetic
gccaagcatttaggtgacactataggtactgttcatattcatcccgtttcagagctatgctggaaacagc

SEQ ID NO: 55572 - DNA, 70 bp, Artificial Sequence
  Synthetic
gccaagcatttaggtgacactatagtaagagaccagacattaagagtttcagagctatgctggaaacagc

SEQ ID NO: 55573 - DNA, 70 bp, Artificial Sequence
  Synthetic
gccaagcatttaggtgacactatagacatccatagatgttgttctgtttcagagctatgctggaaacagc

SEQ ID NO: 55574 - DNA, 70 bp, Artificial Sequence
  Synthetic
gccaagcatttaggtgacactatagtgcttcgtttgaagatgatggtttcagagctatgctggaaacagc

SEQ ID NO: 55575 - DNA, 70 bp, Artificial Sequence
  Synthetic
gccaagcatttaggtgacactatagattccctgtgcaccgtagcagtttcagagctatgctggaaacagc

SEQ ID NO: 55576 - DNA, 70 bp, Artificial Sequence
  Synthetic
gccaagcatttaggtgacactatagaggcttaacagctcttgacggtttcagagctatgctggaaacagc

SEQ ID NO: 55577 - DNA, 70 bp, Artificial Sequence
  Synthetic
gccaagcatttaggtgacactatagtggaggcagtggtagcctaggtttcagagctatgctggaaacagc

SEQ ID NO: 55578 - DNA, 70 bp, Artificial Sequence
  Synthetic
gccaagcatttaggtgacactatagtcactttcacatctccagcagtttcagagctatgctggaaacagc

SEQ ID NO: 55579 - DNA, 70 bp, Artificial Sequence
  Synthetic
gccaagcatttaggtgacactataggtggctgcccagtggttcaagtttcagagctatgctggaaacagc

SEQ ID NO: 55580 - DNA, 70 bp, Artificial Sequence
  Synthetic
gccaagcatttaggtgacactatagcaccacctcaaccaataaacgtttcagagctatgctggaaacagc

SEQ ID NO: 55581 - DNA, 70 bp, Artificial Sequence
  Synthetic
gccaagcatttaggtgacactataggcgagggctcagctctccccgtttcagagctatgctggaaacagc

SEQ ID NO: 55582 - DNA, 70 bp, Artificial Sequence
  Synthetic
gccaagcatttaggtgacactatagattcttgaatagaggaatgggtttcagagctatgctggaaacagc

SEQ ID NO: 55583 - DNA, 70 bp, Artificial Sequence
  Synthetic
gccaagcatttaggtgacactatagccagctggcatgcaataacagtttcagagctatgctggaaacagc

SEQ ID NO: 55584 - DNA, 70 bp, Artificial Sequence
  Synthetic
gccaagcatttaggtgacactatagaagatggcattcacaattacgtttcagagctatgctggaaacagc

SEQ ID NO: 55585 - DNA, 70 bp, Artificial Sequence
  Synthetic
gccaagcatttaggtgacactatagtcattagactgggttctagggtttcagagctatgctggaaacagc

SEQ ID NO: 55586 - DNA, 70 bp, Artificial Sequence
  Synthetic
gccaagcatttaggtgacactataggcccaagcgacgcacttagagtttcagagctatgctggaaacagc

SEQ ID NO: 55587 - DNA, 70 bp, Artificial Sequence
  Synthetic
gccaagcatttaggtgacactatagggtcccccaggctctacaccgtttcagagctatgctggaaacagc

SEQ ID NO: 55588 - DNA, 70 bp, Artificial Sequence
  Synthetic
gccaagcatttaggtgacactatagttaagtacattctggacagcgtttcagagctatgctggaaacagc

SEQ ID NO: 55589 - DNA, 70 bp, Artificial Sequence
  Synthetic
gccaagcatttaggtgacactatagaactatacgtaaatctgctcgtttcagagctatgctggaaacagc

SEQ ID NO: 55590 - DNA, 70 bp, Artificial Sequence
  Synthetic
gccaagcatttaggtgacactatagggaaaatctccagaaggagcgtttcagagctatgctggaaacagc

SEQ ID NO: 55591 - DNA, 70 bp, Artificial Sequence
  Synthetic
gccaagcatttaggtgacactatagagccccctcccactcctcacgtttcagagctatgctggaaacagc

SEQ ID NO: 55592 - DNA, 70 bp, Artificial Sequence
  Synthetic
gccaagcatttaggtgacactatagatgtccagttgagctactgagtttcagagctatgctggaaacagc

SEQ ID NO: 55593 - DNA, 70 bp, Artificial Sequence
  Synthetic
gccaagcatttaggtgacactatagcttgtcccaccacttgaagggtttcagagctatgctggaaacagc

SEQ ID NO: 55594 - DNA, 70 bp, Artificial Sequence
  Synthetic
gccaagcatttaggtgacactatagtcgactctcccaaaagaggtgtttcagagctatgctggaaacagc

SEQ ID NO: 55595 - DNA, 70 bp, Artificial Sequence
  Synthetic
gccaagcatttaggtgacactatagaaagaagacccttaatcagggtttcagagctatgctggaaacagc

SEQ ID NO: 55596 - DNA, 70 bp, Artificial Sequence
  Synthetic
gccaagcatttaggtgacactataggtccagccctacctatagaagtttcagagctatgctggaaacagc

SEQ ID NO: 55597 - DNA, 70 bp, Artificial Sequence
  Synthetic
gccaagcatttaggtgacactatagggacgccgccctggtcttatgtttcagagctatgctggaaacagc

SEQ ID NO: 55598 - DNA, 70 bp, Artificial Sequence
  Synthetic
gccaagcatttaggtgacactatagaaacccttctgcgcctgagggtttcagagctatgctggaaacagc

SEQ ID NO: 55599 - DNA, 70 bp, Artificial Sequence
  Synthetic
gccaagcatttaggtgacactatagggtatgtccgacatttaacggtttcagagctatgctggaaacagc

SEQ ID NO: 55600 - DNA, 70 bp, Artificial Sequence
  Synthetic
gccaagcatttaggtgacactataggtgcagtgccagtacccgtcgtttcagagctatgctggaaacagc

SEQ ID NO: 55601 - DNA, 70 bp, Artificial Sequence
  Synthetic
gccaagcatttaggtgacactatagatcaaagggacttgtggctggtttcagagctatgctggaaacagc

SEQ ID NO: 55602 - DNA, 70 bp, Artificial Sequence
  Synthetic
gccaagcatttaggtgacactatagcctcacagacagttgcgtccgtttcagagctatgctggaaacagc

SEQ ID NO: 55603 - DNA, 70 bp, Artificial Sequence
  Synthetic
gccaagcatttaggtgacactataggatagagaaagatgacccacgtttcagagctatgctggaaacagc

SEQ ID NO: 55604 - DNA, 70 bp, Artificial Sequence
  Synthetic
gccaagcatttaggtgacactatagacaagaacccaaaaaaggaggtttcagagctatgctggaaacagc

SEQ ID NO: 55605 - DNA, 70 bp, Artificial Sequence
  Synthetic
gccaagcatttaggtgacactatagagctgagttttctcctctgcgtttcagagctatgctggaaacagc

SEQ ID NO: 55606 - DNA, 70 bp, Artificial Sequence
  Synthetic
gccaagcatttaggtgacactatagtagccttaatgcatcgatgggtttcagagctatgctggaaacagc

SEQ ID NO: 55607 - DNA, 70 bp, Artificial Sequence
  Synthetic
gccaagcatttaggtgacactatagagcctggcgggcggagctaagtttcagagctatgctggaaacagc

SEQ ID NO: 55608 - DNA, 70 bp, Artificial Sequence
  Synthetic
gccaagcatttaggtgacactatagggcttcagtctgacacagccgtttcagagctatgctggaaacagc

SEQ ID NO: 55609 - DNA, 70 bp, Artificial Sequence
  Synthetic
gccaagcatttaggtgacactatagggaatccccctacagactaggtttcagagctatgctggaaacagc

SEQ ID NO: 55610 - DNA, 70 bp, Artificial Sequence
  Synthetic
gccaagcatttaggtgacactataggccagtcctattgaggcatggtttcagagctatgctggaaacagc

SEQ ID NO: 55611 - DNA, 70 bp, Artificial Sequence
  Synthetic
gccaagcatttaggtgacactatagagtcccgtggagacgtgagggtttcagagctatgctggaaacagc

SEQ ID NO: 55612 - DNA, 70 bp, Artificial Sequence
  Synthetic
gccaagcatttaggtgacactatagaagccctgggtggggctagagtttcagagctatgctggaaacagc

SEQ ID NO: 55613 - DNA, 70 bp, Artificial Sequence
  Synthetic
gccaagcatttaggtgacactatagggcaactacaggcagacggcgtttcagagctatgctggaaacagc

SEQ ID NO: 55614 - DNA, 70 bp, Artificial Sequence
  Synthetic
gccaagcatttaggtgacactatagccagtctctttaatattcccgtttcagagctatgctggaaacagc

SEQ ID NO: 55615 - DNA, 70 bp, Artificial Sequence
  Synthetic
gccaagcatttaggtgacactatagaccccgtcactagtactcctgtttcagagctatgctggaaacagc

SEQ ID NO: 55616 - DNA, 70 bp, Artificial Sequence
  Synthetic
gccaagcatttaggtgacactatagatgtggacagctgtgagaaggtttcagagctatgctggaaacagc

SEQ ID NO: 55617 - DNA, 70 bp, Artificial Sequence
  Synthetic
gccaagcatttaggtgacactataggggtctgctttccaaagtatgtttcagagctatgctggaaacagc

SEQ ID NO: 55618 - DNA, 70 bp, Artificial Sequence
  Synthetic
gccaagcatttaggtgacactatagaaggcagggttggagttcaggtttcagagctatgctggaaacagc

SEQ ID NO: 55619 - DNA, 70 bp, Artificial Sequence
  Synthetic
gccaagcatttaggtgacactatagctacaggagagtttaaggcagtttcagagctatgctggaaacagc

SEQ ID NO: 55620 - DNA, 70 bp, Artificial Sequence
  Synthetic
gccaagcatttaggtgacactatagttttcagctcttcaaacctcgtttcagagctatgctggaaacagc

SEQ ID NO: 55621 - DNA, 70 bp, Artificial Sequence
  Synthetic
gccaagcatttaggtgacactatagagcacagatgctgccccattgtttcagagctatgctggaaacagc

SEQ ID NO: 55622 - DNA, 70 bp, Artificial Sequence
  Synthetic
gccaagcatttaggtgacactatagcagaaggctcctggggtattgtttcagagctatgctggaaacagc

SEQ ID NO: 55623 - DNA, 70 bp, Artificial Sequence
  Synthetic
gccaagcatttaggtgacactatagctcactggattgaggatgtggtttcagagctatgctggaaacagc

SEQ ID NO: 55624 - DNA, 70 bp, Artificial Sequence
  Synthetic
gccaagcatttaggtgacactatagtgtgtgaccggggcctcagggtttcagagctatgctggaaacagc

SEQ ID NO: 55625 - DNA, 70 bp, Artificial Sequence
  Synthetic
gccaagcatttaggtgacactatagtttgccatagaagaaacagagtttcagagctatgctggaaacagc

SEQ ID NO: 55626 - DNA, 70 bp, Artificial Sequence
  Synthetic
gccaagcatttaggtgacactatagaattggcattttacattggcgtttcagagctatgctggaaacagc

SEQ ID NO: 55627 - DNA, 70 bp, Artificial Sequence
  Synthetic
gccaagcatttaggtgacactatagtagcatcaaaatgaaaccgggtttcagagctatgctggaaacagc

SEQ ID NO: 55628 - DNA, 70 bp, Artificial Sequence
  Synthetic
gccaagcatttaggtgacactatagatgaggcaagtacagctagggtttcagagctatgctggaaacagc

SEQ ID NO: 55629 - DNA, 70 bp, Artificial Sequence
  Synthetic
gccaagcatttaggtgacactatagtgctgctcattttagcactggtttcagagctatgctggaaacagc

SEQ ID NO: 55630 - DNA, 70 bp, Artificial Sequence
  Synthetic
gccaagcatttaggtgacactatagtcttctcttttttcttcctcgtttcagagctatgctggaaacagc

SEQ ID NO: 55631 - DNA, 70 bp, Artificial Sequence
  Synthetic
gccaagcatttaggtgacactatagacccccaaagtgctggagtggtttcagagctatgctggaaacagc

SEQ ID NO: 55632 - DNA, 70 bp, Artificial Sequence
  Synthetic
gccaagcatttaggtgacactatagggttcagctactgagctctggtttcagagctatgctggaaacagc

SEQ ID NO: 55633 - DNA, 70 bp, Artificial Sequence
  Synthetic
gccaagcatttaggtgacactatagatgatgaagagggggagtgagtttcagagctatgctggaaacagc

SEQ ID NO: 55634 - DNA, 70 bp, Artificial Sequence
  Synthetic
gccaagcatttaggtgacactatagctgaccgacgactactgagggtttcagagctatgctggaaacagc

SEQ ID NO: 55635 - DNA, 70 bp, Artificial Sequence
  Synthetic
gccaagcatttaggtgacactatagaagaaaacagaagagacagtgtttcagagctatgctggaaacagc

SEQ ID NO: 55636 - DNA, 70 bp, Artificial Sequence
  Synthetic
gccaagcatttaggtgacactataggcatcagcaagtacagagctgtttcagagctatgctggaaacagc

SEQ ID NO: 55637 - DNA, 70 bp, Artificial Sequence
  Synthetic
gccaagcatttaggtgacactatagtgggaggactcaggcatcaggtttcagagctatgctggaaacagc

SEQ ID NO: 55638 - DNA, 70 bp, Artificial Sequence
  Synthetic
gccaagcatttaggtgacactatagaatgaaagctactcatagcggtttcagagctatgctggaaacagc

SEQ ID NO: 55639 - DNA, 70 bp, Artificial Sequence
  Synthetic
gccaagcatttaggtgacactatagctcagccatctgataaagaggtttcagagctatgctggaaacagc

SEQ ID NO: 55640 - DNA, 70 bp, Artificial Sequence
  Synthetic
gccaagcatttaggtgacactatagctgggacatgggaacctagggtttcagagctatgctggaaacagc

SEQ ID NO: 55641 - DNA, 70 bp, Artificial Sequence
  Synthetic
gccaagcatttaggtgacactatagtttttttcttgtcatgcctcgtttcagagctatgctggaaacagc

SEQ ID NO: 55642 - DNA, 70 bp, Artificial Sequence
  Synthetic
gccaagcatttaggtgacactatagtgactggtgtggcagctcacgtttcagagctatgctggaaacagc

SEQ ID NO: 55643 - DNA, 70 bp, Artificial Sequence
  Synthetic
gccaagcatttaggtgacactatagtattaggacaaaggcacattgtttcagagctatgctggaaacagc

SEQ ID NO: 55644 - DNA, 70 bp, Artificial Sequence
  Synthetic
gccaagcatttaggtgacactatagtctgctcgaagaagagaattgtttcagagctatgctggaaacagc

SEQ ID NO: 55645 - DNA, 70 bp, Artificial Sequence
  Synthetic
gccaagcatttaggtgacactatagctctgagagtggtggtggcagtttcagagctatgctggaaacagc

SEQ ID NO: 55646 - DNA, 70 bp, Artificial Sequence
  Synthetic
gccaagcatttaggtgacactatagtgtcgggaaggagccgctacgtttcagagctatgctggaaacagc

SEQ ID NO: 55647 - DNA, 70 bp, Artificial Sequence
  Synthetic
gccaagcatttaggtgacactatagcaacctcatgaaaatggtgagtttcagagctatgctggaaacagc

SEQ ID NO: 55648 - DNA, 70 bp, Artificial Sequence
  Synthetic
gccaagcatttaggtgacactatagaagaggggatcatttctcacgtttcagagctatgctggaaacagc

SEQ ID NO: 55649 - DNA, 70 bp, Artificial Sequence
  Synthetic
gccaagcatttaggtgacactatagagagttcagacattgtcctggtttcagagctatgctggaaacagc

SEQ ID NO: 55650 - DNA, 70 bp, Artificial Sequence
  Synthetic
gccaagcatttaggtgacactatagccaaactacggacgtaaagcgtttcagagctatgctggaaacagc

SEQ ID NO: 55651 - DNA, 70 bp, Artificial Sequence
  Synthetic
gccaagcatttaggtgacactataggtggtcaatccgaagtatgagtttcagagctatgctggaaacagc

SEQ ID NO: 55652 - DNA, 70 bp, Artificial Sequence
  Synthetic
gccaagcatttaggtgacactatagtaatacagagtcaaaagcgggtttcagagctatgctggaaacagc

SEQ ID NO: 55653 - DNA, 70 bp, Artificial Sequence
  Synthetic
gccaagcatttaggtgacactatagggaagaggaggaagcaatgggtttcagagctatgctggaaacagc

SEQ ID NO: 55654 - DNA, 70 bp, Artificial Sequence
  Synthetic
gccaagcatttaggtgacactatagccccaagtttgctgagagttgtttcagagctatgctggaaacagc

SEQ ID NO: 55655 - DNA, 70 bp, Artificial Sequence
  Synthetic
gccaagcatttaggtgacactatagctgcttatcattaagtgcccgtttcagagctatgctggaaacagc

SEQ ID NO: 55656 - DNA, 70 bp, Artificial Sequence
  Synthetic
gccaagcatttaggtgacactatagagagagcttgaaaatctcatgtttcagagctatgctggaaacagc

SEQ ID NO: 55657 - DNA, 70 bp, Artificial Sequence
  Synthetic
gccaagcatttaggtgacactataggatcaggcagatgcagaagtgtttcagagctatgctggaaacagc

SEQ ID NO: 55658 - DNA, 70 bp, Artificial Sequence
  Synthetic
gccaagcatttaggtgacactataggggcagggtgcggtcaagttgtttcagagctatgctggaaacagc

SEQ ID NO: 55659 - DNA, 70 bp, Artificial Sequence
  Synthetic
gccaagcatttaggtgacactatagcaaatcctacaatggcactggtttcagagctatgctggaaacagc

SEQ ID NO: 55660 - DNA, 70 bp, Artificial Sequence
  Synthetic
gccaagcatttaggtgacactatagaaagtagttctagcaatctggtttcagagctatgctggaaacagc

SEQ ID NO: 55661 - DNA, 70 bp, Artificial Sequence
  Synthetic
gccaagcatttaggtgacactatagcagacagtcccactctctgagtttcagagctatgctggaaacagc

SEQ ID NO: 55662 - DNA, 70 bp, Artificial Sequence
  Synthetic
gccaagcatttaggtgacactatagtttcttcaggcttctcacgtgtttcagagctatgctggaaacagc

SEQ ID NO: 55663 - DNA, 70 bp, Artificial Sequence
  Synthetic
gccaagcatttaggtgacactatagaatgcatgtgaaatctggctgtttcagagctatgctggaaacagc

SEQ ID NO: 55664 - DNA, 70 bp, Artificial Sequence
  Synthetic
gccaagcatttaggtgacactatagccagagggctcagaagatgtgtttcagagctatgctggaaacagc

SEQ ID NO: 55665 - DNA, 70 bp, Artificial Sequence
  Synthetic
gccaagcatttaggtgacactataggctttctcaaacggccttaagtttcagagctatgctggaaacagc

SEQ ID NO: 55666 - DNA, 70 bp, Artificial Sequence
  Synthetic
gccaagcatttaggtgacactatagctggtgtgtctactcaaaacgtttcagagctatgctggaaacagc

SEQ ID NO: 55667 - DNA, 70 bp, Artificial Sequence
  Synthetic
gccaagcatttaggtgacactatagggagatttcctgctggtctggtttcagagctatgctggaaacagc

SEQ ID NO: 55668 - DNA, 70 bp, Artificial Sequence
  Synthetic
gccaagcatttaggtgacactatagatttccttttgccagcatccgtttcagagctatgctggaaacagc

SEQ ID NO: 55669 - DNA, 70 bp, Artificial Sequence
  Synthetic
gccaagcatttaggtgacactatagctgccagcttcagagctcccgtttcagagctatgctggaaacagc

SEQ ID NO: 55670 - DNA, 70 bp, Artificial Sequence
  Synthetic
gccaagcatttaggtgacactatagtggaattcagaagccatcacgtttcagagctatgctggaaacagc

SEQ ID NO: 55671 - DNA, 70 bp, Artificial Sequence
  Synthetic
gccaagcatttaggtgacactatagctggctgaaattgcagaatcgtttcagagctatgctggaaacagc

SEQ ID NO: 55672 - DNA, 70 bp, Artificial Sequence
  Synthetic
gccaagcatttaggtgacactatagcagcagccgtgagataactggtttcagagctatgctggaaacagc

SEQ ID NO: 55673 - DNA, 70 bp, Artificial Sequence
  Synthetic
gccaagcatttaggtgacactatagcagtcgggagataacggagggtttcagagctatgctggaaacagc

SEQ ID NO: 55674 - DNA, 70 bp, Artificial Sequence
  Synthetic
gccaagcatttaggtgacactatagcaagatctgtcaagagtaaggtttcagagctatgctggaaacagc

SEQ ID NO: 55675 - DNA, 70 bp, Artificial Sequence
  Synthetic
gccaagcatttaggtgacactatagccagcaattgtttcgcaattgtttcagagctatgctggaaacagc

SEQ ID NO: 55676 - DNA, 70 bp, Artificial Sequence
  Synthetic
gccaagcatttaggtgacactatagctcatctgcggggtggtgtggtttcagagctatgctggaaacagc

SEQ ID NO: 55677 - DNA, 70 bp, Artificial Sequence
  Synthetic
gccaagcatttaggtgacactatagccctgaaggaagtacttcaggtttcagagctatgctggaaacagc

SEQ ID NO: 55678 - DNA, 70 bp, Artificial Sequence
  Synthetic
gccaagcatttaggtgacactataggcaggagtactttggcagttgtttcagagctatgctggaaacagc

SEQ ID NO: 55679 - DNA, 70 bp, Artificial Sequence
  Synthetic
gccaagcatttaggtgacactatagggggtggagtggcagtagcagtttcagagctatgctggaaacagc

SEQ ID NO: 55680 - DNA, 70 bp, Artificial Sequence
  Synthetic
gccaagcatttaggtgacactatagtgacagcttcctacttcagtgtttcagagctatgctggaaacagc

SEQ ID NO: 55681 - DNA, 70 bp, Artificial Sequence
  Synthetic
gccaagcatttaggtgacactatagggtcccggctccgtggctacgtttcagagctatgctggaaacagc

SEQ ID NO: 55682 - DNA, 70 bp, Artificial Sequence
  Synthetic
gccaagcatttaggtgacactataggccagcctggctgagagatggtttcagagctatgctggaaacagc

SEQ ID NO: 55683 - DNA, 70 bp, Artificial Sequence
  Synthetic
gccaagcatttaggtgacactataggcgtgggcagctcaggcgaggtttcagagctatgctggaaacagc

SEQ ID NO: 55684 - DNA, 70 bp, Artificial Sequence
  Synthetic
gccaagcatttaggtgacactataggatctgcctcctgcaggggcgtttcagagctatgctggaaacagc

SEQ ID NO: 55685 - DNA, 70 bp, Artificial Sequence
  Synthetic
gccaagcatttaggtgacactatagtttgcttatgctggttgttggtttcagagctatgctggaaacagc

SEQ ID NO: 55686 - DNA, 70 bp, Artificial Sequence
  Synthetic
gccaagcatttaggtgacactatagttccccccatggtatcagtggtttcagagctatgctggaaacagc

SEQ ID NO: 55687 - DNA, 70 bp, Artificial Sequence
  Synthetic
gccaagcatttaggtgacactatagccttcggtggctctcctcaggtttcagagctatgctggaaacagc

SEQ ID NO: 55688 - DNA, 70 bp, Artificial Sequence
  Synthetic
gccaagcatttaggtgacactatagtgtaaaagacgtcagcttttgtttcagagctatgctggaaacagc

SEQ ID NO: 55689 - DNA, 70 bp, Artificial Sequence
  Synthetic
gccaagcatttaggtgacactatagcatcaaggtgctgcagccaggtttcagagctatgctggaaacagc

SEQ ID NO: 55690 - DNA, 70 bp, Artificial Sequence
  Synthetic
gccaagcatttaggtgacactataggggtttacggttcaccttcagtttcagagctatgctggaaacagc

SEQ ID NO: 55691 - DNA, 70 bp, Artificial Sequence
  Synthetic
gccaagcatttaggtgacactatagcatatgattcattgctggctgtttcagagctatgctggaaacagc

SEQ ID NO: 55692 - DNA, 70 bp, Artificial Sequence
  Synthetic
gccaagcatttaggtgacactataggcagttgtttgatgagccgtgtttcagagctatgctggaaacagc

SEQ ID NO: 55693 - DNA, 70 bp, Artificial Sequence
  Synthetic
gccaagcatttaggtgacactatagctgtcctttagaacccctacgtttcagagctatgctggaaacagc

SEQ ID NO: 55694 - DNA, 70 bp, Artificial Sequence
  Synthetic
gccaagcatttaggtgacactatagctgctgctggctagctctcggtttcagagctatgctggaaacagc

SEQ ID NO: 55695 - DNA, 70 bp, Artificial Sequence
  Synthetic
gccaagcatttaggtgacactatagggagagatcaacggggtgacgtttcagagctatgctggaaacagc

SEQ ID NO: 55696 - DNA, 70 bp, Artificial Sequence
  Synthetic
gccaagcatttaggtgacactatagctagtgaaagtctgcattgagtttcagagctatgctggaaacagc

SEQ ID NO: 55697 - DNA, 70 bp, Artificial Sequence
  Synthetic
gccaagcatttaggtgacactatagtgcgggtggttatttatgttgtttcagagctatgctggaaacagc

SEQ ID NO: 55698 - DNA, 70 bp, Artificial Sequence
  Synthetic
gccaagcatttaggtgacactatagggctccattcatttgactcagtttcagagctatgctggaaacagc

SEQ ID NO: 55699 - DNA, 70 bp, Artificial Sequence
  Synthetic
gccaagcatttaggtgacactatagcattccaggcaaggtcacaagtttcagagctatgctggaaacagc

SEQ ID NO: 55700 - DNA, 70 bp, Artificial Sequence
  Synthetic
gccaagcatttaggtgacactatagaaaaattatcctgaaggagcgtttcagagctatgctggaaacagc

SEQ ID NO: 55701 - DNA, 70 bp, Artificial Sequence
  Synthetic
gccaagcatttaggtgacactatagatcatggtgacagtgtaggcgtttcagagctatgctggaaacagc

SEQ ID NO: 55702 - DNA, 70 bp, Artificial Sequence
  Synthetic
gccaagcatttaggtgacactatagcatcagcagcttttcatgtggtttcagagctatgctggaaacagc

SEQ ID NO: 55703 - DNA, 70 bp, Artificial Sequence
  Synthetic
gccaagcatttaggtgacactatagaagaaaaggccacagattcggtttcagagctatgctggaaacagc

SEQ ID NO: 55704 - DNA, 70 bp, Artificial Sequence
  Synthetic
gccaagcatttaggtgacactataggccagtttaactcacagtccgtttcagagctatgctggaaacagc

SEQ ID NO: 55705 - DNA, 70 bp, Artificial Sequence
  Synthetic
gccaagcatttaggtgacactatagaggaaaggaacggcaggaacgtttcagagctatgctggaaacagc

SEQ ID NO: 55706 - DNA, 70 bp, Artificial Sequence
  Synthetic
gccaagcatttaggtgacactatagcactgcaaccgctgcctctcgtttcagagctatgctggaaacagc

SEQ ID NO: 55707 - DNA, 70 bp, Artificial Sequence
  Synthetic
gccaagcatttaggtgacactatagaaactcctgctgcagtaggagtttcagagctatgctggaaacagc

SEQ ID NO: 55708 - DNA, 70 bp, Artificial Sequence
  Synthetic
gccaagcatttaggtgacactatagggggaagatagatgagaagggtttcagagctatgctggaaacagc

SEQ ID NO: 55709 - DNA, 70 bp, Artificial Sequence
  Synthetic
gccaagcatttaggtgacactatagacactcagcagcatcttccagtttcagagctatgctggaaacagc

SEQ ID NO: 55710 - DNA, 70 bp, Artificial Sequence
  Synthetic
gccaagcatttaggtgacactatagcattatcaggagaagcatctgtttcagagctatgctggaaacagc

SEQ ID NO: 55711 - DNA, 70 bp, Artificial Sequence
  Synthetic
gccaagcatttaggtgacactatagtgtcaatcattaccctctccgtttcagagctatgctggaaacagc

SEQ ID NO: 55712 - DNA, 70 bp, Artificial Sequence
  Synthetic
gccaagcatttaggtgacactatagagggaagggggtgagttagggtttcagagctatgctggaaacagc

SEQ ID NO: 55713 - DNA, 70 bp, Artificial Sequence
  Synthetic
gccaagcatttaggtgacactatagtttcccacagttcaatgcaagtttcagagctatgctggaaacagc

SEQ ID NO: 55714 - DNA, 70 bp, Artificial Sequence
  Synthetic
gccaagcatttaggtgacactataggctatacgatgtactccattgtttcagagctatgctggaaacagc

SEQ ID NO: 55715 - DNA, 70 bp, Artificial Sequence
  Synthetic
gccaagcatttaggtgacactataggctacgccggcaaggagtaggtttcagagctatgctggaaacagc

SEQ ID NO: 55716 - DNA, 70 bp, Artificial Sequence
  Synthetic
gccaagcatttaggtgacactatagctcttggttcaccagcacacgtttcagagctatgctggaaacagc

SEQ ID NO: 55717 - DNA, 70 bp, Artificial Sequence
  Synthetic
gccaagcatttaggtgacactatagagctttcagaaccttattgagtttcagagctatgctggaaacagc

SEQ ID NO: 55718 - DNA, 70 bp, Artificial Sequence
  Synthetic
gccaagcatttaggtgacactatagcaaataagggataacatggcgtttcagagctatgctggaaacagc

SEQ ID NO: 55719 - DNA, 70 bp, Artificial Sequence
  Synthetic
gccaagcatttaggtgacactatagtgcgggcaggagctatgaaagtttcagagctatgctggaaacagc

SEQ ID NO: 55720 - DNA, 70 bp, Artificial Sequence
  Synthetic
gccaagcatttaggtgacactatagtaacagctcgttctgatcctgtttcagagctatgctggaaacagc

SEQ ID NO: 55721 - DNA, 70 bp, Artificial Sequence
  Synthetic
gccaagcatttaggtgacactatagtctcactagcattcattctggtttcagagctatgctggaaacagc

SEQ ID NO: 55722 - DNA, 70 bp, Artificial Sequence
  Synthetic
gccaagcatttaggtgacactatagtctctcttgcctttattctagtttcagagctatgctggaaacagc

SEQ ID NO: 55723 - DNA, 70 bp, Artificial Sequence
  Synthetic
gccaagcatttaggtgacactatagtgggatcttatccatgttttgtttcagagctatgctggaaacagc

SEQ ID NO: 55724 - DNA, 70 bp, Artificial Sequence
  Synthetic
gccaagcatttaggtgacactatagtctccttagctttcattctcgtttcagagctatgctggaaacagc

SEQ ID NO: 55725 - DNA, 70 bp, Artificial Sequence
  Synthetic
gccaagcatttaggtgacactatagtttcagaaacaacagaggctgtttcagagctatgctggaaacagc

SEQ ID NO: 55726 - DNA, 70 bp, Artificial Sequence
  Synthetic
gccaagcatttaggtgacactataggccgcggcgggcggatcacggtttcagagctatgctggaaacagc

SEQ ID NO: 55727 - DNA, 70 bp, Artificial Sequence
  Synthetic
gccaagcatttaggtgacactataggtatgctatgctcagaggaagtttcagagctatgctggaaacagc

SEQ ID NO: 55728 - DNA, 70 bp, Artificial Sequence
  Synthetic
gccaagcatttaggtgacactatagctacatccgcactgacgagggtttcagagctatgctggaaacagc

SEQ ID NO: 55729 - DNA, 70 bp, Artificial Sequence
  Synthetic
gccaagcatttaggtgacactataggactctccattcttctcaaagtttcagagctatgctggaaacagc

SEQ ID NO: 55730 - DNA, 70 bp, Artificial Sequence
  Synthetic
gccaagcatttaggtgacactatagtgatgagctcgaagcactttgtttcagagctatgctggaaacagc

SEQ ID NO: 55731 - DNA, 70 bp, Artificial Sequence
  Synthetic
gccaagcatttaggtgacactatagcggtgtcggctgagattatcgtttcagagctatgctggaaacagc

SEQ ID NO: 55732 - DNA, 70 bp, Artificial Sequence
  Synthetic
gccaagcatttaggtgacactatagtgaccctagcagagtggagagtttcagagctatgctggaaacagc

SEQ ID NO: 55733 - DNA, 70 bp, Artificial Sequence
  Synthetic
gccaagcatttaggtgacactatagtagtcaggatagcaggcatcgtttcagagctatgctggaaacagc

SEQ ID NO: 55734 - DNA, 70 bp, Artificial Sequence
  Synthetic
gccaagcatttaggtgacactatagttctcgagctgctcgagcaggtttcagagctatgctggaaacagc

SEQ ID NO: 55735 - DNA, 70 bp, Artificial Sequence
  Synthetic
gccaagcatttaggtgacactataggtgcttcaggcagttggtgggtttcagagctatgctggaaacagc

SEQ ID NO: 55736 - DNA, 70 bp, Artificial Sequence
  Synthetic
gccaagcatttaggtgacactatagtgtctacactcagtgtccatgtttcagagctatgctggaaacagc

SEQ ID NO: 55737 - DNA, 70 bp, Artificial Sequence
  Synthetic
gccaagcatttaggtgacactatagcgaggatgaagtagaggatagtttcagagctatgctggaaacagc

SEQ ID NO: 55738 - DNA, 70 bp, Artificial Sequence
  Synthetic
gccaagcatttaggtgacactatagatcctcacgacaggtgctatgtttcagagctatgctggaaacagc

SEQ ID NO: 55739 - DNA, 70 bp, Artificial Sequence
  Synthetic
gccaagcatttaggtgacactatagaacagccttgctgggtcaccgtttcagagctatgctggaaacagc

SEQ ID NO: 55740 - DNA, 70 bp, Artificial Sequence
  Synthetic
gccaagcatttaggtgacactataggagtctctttatctgctcaggtttcagagctatgctggaaacagc

SEQ ID NO: 55741 - DNA, 70 bp, Artificial Sequence
  Synthetic
gccaagcatttaggtgacactatagaggcttcaggccttgactgagtttcagagctatgctggaaacagc

SEQ ID NO: 55742 - DNA, 70 bp, Artificial Sequence
  Synthetic
gccaagcatttaggtgacactatagcgaggaggcggcagctgggggtttcagagctatgctggaaacagc

SEQ ID NO: 55743 - DNA, 70 bp, Artificial Sequence
  Synthetic
gccaagcatttaggtgacactataggcaggggccccggccatcaggtttcagagctatgctggaaacagc

SEQ ID NO: 55744 - DNA, 70 bp, Artificial Sequence
  Synthetic
gccaagcatttaggtgacactatagtgagcgtagcatgccaccaggtttcagagctatgctggaaacagc

SEQ ID NO: 55745 - DNA, 70 bp, Artificial Sequence
  Synthetic
gccaagcatttaggtgacactatagccagctgttttggctagccggtttcagagctatgctggaaacagc

SEQ ID NO: 55746 - DNA, 70 bp, Artificial Sequence
  Synthetic
gccaagcatttaggtgacactatagggctttaccttgcacagactgtttcagagctatgctggaaacagc

SEQ ID NO: 55747 - DNA, 70 bp, Artificial Sequence
  Synthetic
gccaagcatttaggtgacactatagtgggcagaactgttacacatgtttcagagctatgctggaaacagc

SEQ ID NO: 55748 - DNA, 70 bp, Artificial Sequence
  Synthetic
gccaagcatttaggtgacactatagaggagaagggcagctggctggtttcagagctatgctggaaacagc

SEQ ID NO: 55749 - DNA, 70 bp, Artificial Sequence
  Synthetic
gccaagcatttaggtgacactatagcatgctgttgaatatcgggtgtttcagagctatgctggaaacagc

SEQ ID NO: 55750 - DNA, 70 bp, Artificial Sequence
  Synthetic
gccaagcatttaggtgacactatagaccgagacctatgctgatgggtttcagagctatgctggaaacagc

SEQ ID NO: 55751 - DNA, 70 bp, Artificial Sequence
  Synthetic
gccaagcatttaggtgacactatagtggtaagcgacggtcaggtcgtttcagagctatgctggaaacagc

SEQ ID NO: 55752 - DNA, 70 bp, Artificial Sequence
  Synthetic
gccaagcatttaggtgacactatagatggtgatcttgctcaacatgtttcagagctatgctggaaacagc

SEQ ID NO: 55753 - DNA, 70 bp, Artificial Sequence
  Synthetic
gccaagcatttaggtgacactatagcatgcgtgtcaggtgcactggtttcagagctatgctggaaacagc

SEQ ID NO: 55754 - DNA, 70 bp, Artificial Sequence
  Synthetic
gccaagcatttaggtgacactatagctgggctctcactgagcagagtttcagagctatgctggaaacagc

SEQ ID NO: 55755 - DNA, 70 bp, Artificial Sequence
  Synthetic
gccaagcatttaggtgacactatagttctcccagctcctcacctggtttcagagctatgctggaaacagc

SEQ ID NO: 55756 - DNA, 70 bp, Artificial Sequence
  Synthetic
gccaagcatttaggtgacactatagagggccagggatgaactcacgtttcagagctatgctggaaacagc

SEQ ID NO: 55757 - DNA, 70 bp, Artificial Sequence
  Synthetic
gccaagcatttaggtgacactatagggcaagtccagcctcgtcttgtttcagagctatgctggaaacagc

SEQ ID NO: 55758 - DNA, 70 bp, Artificial Sequence
  Synthetic
gccaagcatttaggtgacactataggagcctgactgtacatctctgtttcagagctatgctggaaacagc

SEQ ID NO: 55759 - DNA, 70 bp, Artificial Sequence
  Synthetic
gccaagcatttaggtgacactataggcttctcttcactctgccccgtttcagagctatgctggaaacagc

SEQ ID NO: 55760 - DNA, 70 bp, Artificial Sequence
  Synthetic
gccaagcatttaggtgacactatagcagtggcttctcttagtagagtttcagagctatgctggaaacagc

SEQ ID NO: 55761 - DNA, 70 bp, Artificial Sequence
  Synthetic
gccaagcatttaggtgacactatagccaacattatgtctctgtaggtttcagagctatgctggaaacagc

SEQ ID NO: 55762 - DNA, 70 bp, Artificial Sequence
  Synthetic
gccaagcatttaggtgacactatagccacagcaggtgacaactgagtttcagagctatgctggaaacagc

SEQ ID NO: 55763 - DNA, 70 bp, Artificial Sequence
  Synthetic
gccaagcatttaggtgacactatagtatgattctacctgatagacgtttcagagctatgctggaaacagc

SEQ ID NO: 55764 - DNA, 70 bp, Artificial Sequence
  Synthetic
gccaagcatttaggtgacactatagggcaaggggcgggactgagcgtttcagagctatgctggaaacagc

SEQ ID NO: 55765 - DNA, 70 bp, Artificial Sequence
  Synthetic
gccaagcatttaggtgacactatagaagggtggaatgtagctatagtttcagagctatgctggaaacagc

SEQ ID NO: 55766 - DNA, 70 bp, Artificial Sequence
  Synthetic
gccaagcatttaggtgacactatagactgctgcgttagcatgagtgtttcagagctatgctggaaacagc

SEQ ID NO: 55767 - DNA, 70 bp, Artificial Sequence
  Synthetic
gccaagcatttaggtgacactatagaggggcaggggacgttcagagtttcagagctatgctggaaacagc

SEQ ID NO: 55768 - DNA, 70 bp, Artificial Sequence
  Synthetic
gccaagcatttaggtgacactatagccgcgcgcggactcagtacggtttcagagctatgctggaaacagc

SEQ ID NO: 55769 - DNA, 70 bp, Artificial Sequence
  Synthetic
gccaagcatttaggtgacactatagagaccacatgctggcctagggtttcagagctatgctggaaacagc

SEQ ID NO: 55770 - DNA, 70 bp, Artificial Sequence
  Synthetic
gccaagcatttaggtgacactatagcacaggtgaaagagaagtaagtttcagagctatgctggaaacagc

SEQ ID NO: 55771 - DNA, 70 bp, Artificial Sequence
  Synthetic
gccaagcatttaggtgacactatagcagcagcagaaagtagtgacgtttcagagctatgctggaaacagc

SEQ ID NO: 55772 - DNA, 70 bp, Artificial Sequence
  Synthetic
gccaagcatttaggtgacactatagggatgcgcgctaaacgtaaggtttcagagctatgctggaaacagc

SEQ ID NO: 55773 - DNA, 70 bp, Artificial Sequence
  Synthetic
gccaagcatttaggtgacactatagtgggagatggctacgtccctgtttcagagctatgctggaaacagc

SEQ ID NO: 55774 - DNA, 70 bp, Artificial Sequence
  Synthetic
gccaagcatttaggtgacactatagatcaatcaaatgaacctcgggtttcagagctatgctggaaacagc

SEQ ID NO: 55775 - DNA, 70 bp, Artificial Sequence
  Synthetic
gccaagcatttaggtgacactatagtcacggctactcttctgccggtttcagagctatgctggaaacagc

SEQ ID NO: 55776 - DNA, 70 bp, Artificial Sequence
  Synthetic
gccaagcatttaggtgacactatagacgaggcagcttactgaaccgtttcagagctatgctggaaacagc

SEQ ID NO: 55777 - DNA, 70 bp, Artificial Sequence
  Synthetic
gccaagcatttaggtgacactataggcaggtccctggggctgtaggtttcagagctatgctggaaacagc

SEQ ID NO: 55778 - DNA, 70 bp, Artificial Sequence
  Synthetic
gccaagcatttaggtgacactatagcgcccgactcacagatgagcgtttcagagctatgctggaaacagc

SEQ ID NO: 55779 - DNA, 70 bp, Artificial Sequence
  Synthetic
gccaagcatttaggtgacactatagattagtaagtcctagaccaagtttcagagctatgctggaaacagc

SEQ ID NO: 55780 - DNA, 70 bp, Artificial Sequence
  Synthetic
gccaagcatttaggtgacactatagcaactaatagaagtgggttcgtttcagagctatgctggaaacagc

SEQ ID NO: 55781 - DNA, 70 bp, Artificial Sequence
  Synthetic
gccaagcatttaggtgacactatagacacagcatcttcagggtgcgtttcagagctatgctggaaacagc

SEQ ID NO: 55782 - DNA, 70 bp, Artificial Sequence
  Synthetic
gccaagcatttaggtgacactatagggtgctgccctccagctcacgtttcagagctatgctggaaacagc

SEQ ID NO: 55783 - DNA, 70 bp, Artificial Sequence
  Synthetic
gccaagcatttaggtgacactatagacactggaaagcacaacagtgtttcagagctatgctggaaacagc

SEQ ID NO: 55784 - DNA, 70 bp, Artificial Sequence
  Synthetic
gccaagcatttaggtgacactatagagctgtattcgcatcagcgcgtttcagagctatgctggaaacagc

SEQ ID NO: 55785 - DNA, 70 bp, Artificial Sequence
  Synthetic
gccaagcatttaggtgacactataggggaggcctcattgacaagtgtttcagagctatgctggaaacagc

SEQ ID NO: 55786 - DNA, 70 bp, Artificial Sequence
  Synthetic
gccaagcatttaggtgacactatagtactgaagaagaatttctccgtttcagagctatgctggaaacagc

SEQ ID NO: 55787 - DNA, 70 bp, Artificial Sequence
  Synthetic
gccaagcatttaggtgacactatagactggagcaagagggggaaggtttcagagctatgctggaaacagc

SEQ ID NO: 55788 - DNA, 70 bp, Artificial Sequence
  Synthetic
gccaagcatttaggtgacactatagcttgctcatcttctcatgtagtttcagagctatgctggaaacagc

SEQ ID NO: 55789 - DNA, 70 bp, Artificial Sequence
  Synthetic
gccaagcatttaggtgacactatagtgatctctaattctctttccgtttcagagctatgctggaaacagc

SEQ ID NO: 55790 - DNA, 70 bp, Artificial Sequence
  Synthetic
gccaagcatttaggtgacactatagtcaatggctcctacatgagagtttcagagctatgctggaaacagc

SEQ ID NO: 55791 - DNA, 70 bp, Artificial Sequence
  Synthetic
gccaagcatttaggtgacactatagcaggtcactttaagtgccctgtttcagagctatgctggaaacagc

SEQ ID NO: 55792 - DNA, 70 bp, Artificial Sequence
  Synthetic
gccaagcatttaggtgacactataggggatcatgtgacagcaatagtttcagagctatgctggaaacagc

SEQ ID NO: 55793 - DNA, 70 bp, Artificial Sequence
  Synthetic
gccaagcatttaggtgacactataggggccaggctgctcacttctgtttcagagctatgctggaaacagc

SEQ ID NO: 55794 - DNA, 70 bp, Artificial Sequence
  Synthetic
gccaagcatttaggtgacactatagaactatggaggatttcgagagtttcagagctatgctggaaacagc

SEQ ID NO: 55795 - DNA, 70 bp, Artificial Sequence
  Synthetic
gccaagcatttaggtgacactatagatctatattcctttgccgtcgtttcagagctatgctggaaacagc

SEQ ID NO: 55796 - DNA, 70 bp, Artificial Sequence
  Synthetic
gccaagcatttaggtgacactataggtctgtctctgctgcagactgtttcagagctatgctggaaacagc

SEQ ID NO: 55797 - DNA, 70 bp, Artificial Sequence
  Synthetic
gccaagcatttaggtgacactatagaggtctgatggttttatcaggtttcagagctatgctggaaacagc

SEQ ID NO: 55798 - DNA, 70 bp, Artificial Sequence
  Synthetic
gccaagcatttaggtgacactatagctagtccattttcatgctgcgtttcagagctatgctggaaacagc

SEQ ID NO: 55799 - DNA, 70 bp, Artificial Sequence
  Synthetic
gccaagcatttaggtgacactataggtcctccctgcctgcaatcagtttcagagctatgctggaaacagc

SEQ ID NO: 55800 - DNA, 70 bp, Artificial Sequence
  Synthetic
gccaagcatttaggtgacactatagtggctcagagatactcagacgtttcagagctatgctggaaacagc

SEQ ID NO: 55801 - DNA, 70 bp, Artificial Sequence
  Synthetic
gccaagcatttaggtgacactatagctcatggccagtctggactggtttcagagctatgctggaaacagc

SEQ ID NO: 55802 - DNA, 70 bp, Artificial Sequence
  Synthetic
gccaagcatttaggtgacactatagactttggttccaggatatacgtttcagagctatgctggaaacagc

SEQ ID NO: 55803 - DNA, 70 bp, Artificial Sequence
  Synthetic
gccaagcatttaggtgacactatagagagaatgacgattactactgtttcagagctatgctggaaacagc

SEQ ID NO: 55804 - DNA, 70 bp, Artificial Sequence
  Synthetic
gccaagcatttaggtgacactataggtcacattccaagtgtcatagtttcagagctatgctggaaacagc

SEQ ID NO: 55805 - DNA, 70 bp, Artificial Sequence
  Synthetic
gccaagcatttaggtgacactatagacatagaggaggacgcggacgtttcagagctatgctggaaacagc

SEQ ID NO: 55806 - DNA, 70 bp, Artificial Sequence
  Synthetic
gccaagcatttaggtgacactatagctggaggtcaccaacgtgtagtttcagagctatgctggaaacagc

SEQ ID NO: 55807 - DNA, 70 bp, Artificial Sequence
  Synthetic
gccaagcatttaggtgacactataggagcagggcgccccgtaggcgtttcagagctatgctggaaacagc

SEQ ID NO: 55808 - DNA, 70 bp, Artificial Sequence
  Synthetic
gccaagcatttaggtgacactataggaagaaggcaatgagcactagtttcagagctatgctggaaacagc

SEQ ID NO: 55809 - DNA, 70 bp, Artificial Sequence
  Synthetic
gccaagcatttaggtgacactatagtgggcctgtgacttcgacaagtttcagagctatgctggaaacagc

SEQ ID NO: 55810 - DNA, 70 bp, Artificial Sequence
  Synthetic
gccaagcatttaggtgacactataggcactaccacctgtatagtggtttcagagctatgctggaaacagc

SEQ ID NO: 55811 - DNA, 70 bp, Artificial Sequence
  Synthetic
gccaagcatttaggtgacactatagtctgttaaggctctaggcatgtttcagagctatgctggaaacagc

SEQ ID NO: 55812 - DNA, 70 bp, Artificial Sequence
  Synthetic
gccaagcatttaggtgacactatagttgcagtttgtgttggcctagtttcagagctatgctggaaacagc

SEQ ID NO: 55813 - DNA, 70 bp, Artificial Sequence
  Synthetic
gccaagcatttaggtgacactatagtgatcctgtgcatttcactggtttcagagctatgctggaaacagc

SEQ ID NO: 55814 - DNA, 70 bp, Artificial Sequence
  Synthetic
gccaagcatttaggtgacactatagcgaaatgcacaggatcagcagtttcagagctatgctggaaacagc

SEQ ID NO: 55815 - DNA, 70 bp, Artificial Sequence
  Synthetic
gccaagcatttaggtgacactatagagtactttctgaagacactggtttcagagctatgctggaaacagc

SEQ ID NO: 55816 - DNA, 70 bp, Artificial Sequence
  Synthetic
gccaagcatttaggtgacactataggaattgggatgtcatcaaaggtttcagagctatgctggaaacagc

SEQ ID NO: 55817 - DNA, 70 bp, Artificial Sequence
  Synthetic
gccaagcatttaggtgacactatagtgctcttattaacgcagtttgtttcagagctatgctggaaacagc

SEQ ID NO: 55818 - DNA, 70 bp, Artificial Sequence
  Synthetic
gccaagcatttaggtgacactataggctgttccacagagaagtctgtttcagagctatgctggaaacagc

SEQ ID NO: 55819 - DNA, 70 bp, Artificial Sequence
  Synthetic
gccaagcatttaggtgacactatagcacatagtttgtgttagccagtttcagagctatgctggaaacagc

SEQ ID NO: 55820 - DNA, 70 bp, Artificial Sequence
  Synthetic
gccaagcatttaggtgacactatagcagctgtaactacattgcacgtttcagagctatgctggaaacagc

SEQ ID NO: 55821 - DNA, 70 bp, Artificial Sequence
  Synthetic
gccaagcatttaggtgacactatagtttgatgttgacacaagagtgtttcagagctatgctggaaacagc

SEQ ID NO: 55822 - DNA, 70 bp, Artificial Sequence
  Synthetic
gccaagcatttaggtgacactatagctgttctaatgcaaaggctggtttcagagctatgctggaaacagc

SEQ ID NO: 55823 - DNA, 70 bp, Artificial Sequence
  Synthetic
gccaagcatttaggtgacactatagccgggaaacagatttgtgaagtttcagagctatgctggaaacagc

SEQ ID NO: 55824 - DNA, 70 bp, Artificial Sequence
  Synthetic
gccaagcatttaggtgacactatagagagaaaagaatgctcacgggtttcagagctatgctggaaacagc

SEQ ID NO: 55825 - DNA, 70 bp, Artificial Sequence
  Synthetic
gccaagcatttaggtgacactatagcacctggtcaccgaagtgtggtttcagagctatgctggaaacagc

SEQ ID NO: 55826 - DNA, 70 bp, Artificial Sequence
  Synthetic
gccaagcatttaggtgacactatagcaacaagccctacagcaagagtttcagagctatgctggaaacagc

SEQ ID NO: 55827 - DNA, 70 bp, Artificial Sequence
  Synthetic
gccaagcatttaggtgacactatagtctgtagtcctttttgctgtgtttcagagctatgctggaaacagc

SEQ ID NO: 55828 - DNA, 70 bp, Artificial Sequence
  Synthetic
gccaagcatttaggtgacactataggcccgcgacagactacttctgtttcagagctatgctggaaacagc

SEQ ID NO: 55829 - DNA, 70 bp, Artificial Sequence
  Synthetic
gccaagcatttaggtgacactatagtctgatctcgtgtgcttccagtttcagagctatgctggaaacagc

SEQ ID NO: 55830 - DNA, 70 bp, Artificial Sequence
  Synthetic
gccaagcatttaggtgacactatagttttgtaactagtcacatgcgtttcagagctatgctggaaacagc

SEQ ID NO: 55831 - DNA, 70 bp, Artificial Sequence
  Synthetic
gccaagcatttaggtgacactatagcagatcgacatgcctctaaggtttcagagctatgctggaaacagc

SEQ ID NO: 55832 - DNA, 70 bp, Artificial Sequence
  Synthetic
gccaagcatttaggtgacactataggctgtgagagtgacttgaccgtttcagagctatgctggaaacagc

SEQ ID NO: 55833 - DNA, 70 bp, Artificial Sequence
  Synthetic
gccaagcatttaggtgacactatagagccataccaaggactatacgtttcagagctatgctggaaacagc

SEQ ID NO: 55834 - DNA, 70 bp, Artificial Sequence
  Synthetic
gccaagcatttaggtgacactatagatcctacatcacctggataagtttcagagctatgctggaaacagc

SEQ ID NO: 55835 - DNA, 70 bp, Artificial Sequence
  Synthetic
gccaagcatttaggtgacactatagggtttacaagatagatgggagtttcagagctatgctggaaacagc

SEQ ID NO: 55836 - DNA, 70 bp, Artificial Sequence
  Synthetic
gccaagcatttaggtgacactatagttaagtaagagatctggcctgtttcagagctatgctggaaacagc

SEQ ID NO: 55837 - DNA, 70 bp, Artificial Sequence
  Synthetic
gccaagcatttaggtgacactatagggagggggttcgtccactaggtttcagagctatgctggaaacagc

SEQ ID NO: 55838 - DNA, 70 bp, Artificial Sequence
  Synthetic
gccaagcatttaggtgacactatagcccagcccccttcctcaatggtttcagagctatgctggaaacagc

SEQ ID NO: 55839 - DNA, 70 bp, Artificial Sequence
  Synthetic
gccaagcatttaggtgacactataggtcctcaccctctcttaaaggtttcagagctatgctggaaacagc

SEQ ID NO: 55840 - DNA, 70 bp, Artificial Sequence
  Synthetic
gccaagcatttaggtgacactatagtcagcaggcctacccctcacgtttcagagctatgctggaaacagc

SEQ ID NO: 55841 - DNA, 70 bp, Artificial Sequence
  Synthetic
gccaagcatttaggtgacactataggaatcccctgagtactcagggtttcagagctatgctggaaacagc

SEQ ID NO: 55842 - DNA, 70 bp, Artificial Sequence
  Synthetic
gccaagcatttaggtgacactatagctctgtccagtggttttacagtttcagagctatgctggaaacagc

SEQ ID NO: 55843 - DNA, 70 bp, Artificial Sequence
  Synthetic
gccaagcatttaggtgacactatagtagccagtggtggggttcatgtttcagagctatgctggaaacagc

SEQ ID NO: 55844 - DNA, 70 bp, Artificial Sequence
  Synthetic
gccaagcatttaggtgacactatagttcaaaatgtccccctgatagtttcagagctatgctggaaacagc

SEQ ID NO: 55845 - DNA, 70 bp, Artificial Sequence
  Synthetic
gccaagcatttaggtgacactatagcgtgttagatcatagacacagtttcagagctatgctggaaacagc

SEQ ID NO: 55846 - DNA, 70 bp, Artificial Sequence
  Synthetic
gccaagcatttaggtgacactataggggggtgctaggaattctgagtttcagagctatgctggaaacagc

SEQ ID NO: 55847 - DNA, 70 bp, Artificial Sequence
  Synthetic
gccaagcatttaggtgacactatagcctcgcccagggcgctgagcgtttcagagctatgctggaaacagc

SEQ ID NO: 55848 - DNA, 70 bp, Artificial Sequence
  Synthetic
gccaagcatttaggtgacactataggctccagagttgcaagtgacgtttcagagctatgctggaaacagc

SEQ ID NO: 55849 - DNA, 70 bp, Artificial Sequence
  Synthetic
gccaagcatttaggtgacactatagccgcgctcagttattgtctcgtttcagagctatgctggaaacagc

SEQ ID NO: 55850 - DNA, 70 bp, Artificial Sequence
  Synthetic
gccaagcatttaggtgacactatagatgcgctgtgggtgcgggcagtttcagagctatgctggaaacagc

SEQ ID NO: 55851 - DNA, 70 bp, Artificial Sequence
  Synthetic
gccaagcatttaggtgacactatagaattcaggaattcagtggaggtttcagagctatgctggaaacagc

SEQ ID NO: 55852 - DNA, 70 bp, Artificial Sequence
  Synthetic
gccaagcatttaggtgacactatagctgagttacatgtgcatgatgtttcagagctatgctggaaacagc

SEQ ID NO: 55853 - DNA, 70 bp, Artificial Sequence
  Synthetic
gccaagcatttaggtgacactatagcatttttggagccagctgaggtttcagagctatgctggaaacagc

SEQ ID NO: 55854 - DNA, 70 bp, Artificial Sequence
  Synthetic
gccaagcatttaggtgacactatagaagcaaaaagtgtctgtttggtttcagagctatgctggaaacagc

SEQ ID NO: 55855 - DNA, 70 bp, Artificial Sequence
  Synthetic
gccaagcatttaggtgacactatagtcggacccgggcagttagtggtttcagagctatgctggaaacagc

SEQ ID NO: 55856 - DNA, 70 bp, Artificial Sequence
  Synthetic
gccaagcatttaggtgacactataggacccaggaagaaggcacaggtttcagagctatgctggaaacagc

SEQ ID NO: 55857 - DNA, 70 bp, Artificial Sequence
  Synthetic
gccaagcatttaggtgacactataggggccctgggccagggtcaggtttcagagctatgctggaaacagc

SEQ ID NO: 55858 - DNA, 70 bp, Artificial Sequence
  Synthetic
gccaagcatttaggtgacactatagcatccaggatgatgaggtgggtttcagagctatgctggaaacagc

SEQ ID NO: 55859 - DNA, 70 bp, Artificial Sequence
  Synthetic
gccaagcatttaggtgacactatagttgtcagattcaggtgattcgtttcagagctatgctggaaacagc

SEQ ID NO: 55860 - DNA, 70 bp, Artificial Sequence
  Synthetic
gccaagcatttaggtgacactataggtctttatcttggagttcaggtttcagagctatgctggaaacagc

SEQ ID NO: 55861 - DNA, 70 bp, Artificial Sequence
  Synthetic
gccaagcatttaggtgacactatagttccggcttttattccatttgtttcagagctatgctggaaacagc

SEQ ID NO: 55862 - DNA, 70 bp, Artificial Sequence
  Synthetic
gccaagcatttaggtgacactatagtttctgatcctggtcttccagtttcagagctatgctggaaacagc

SEQ ID NO: 55863 - DNA, 70 bp, Artificial Sequence
  Synthetic
gccaagcatttaggtgacactataggtgcttgtgacaacttccaggtttcagagctatgctggaaacagc

SEQ ID NO: 55864 - DNA, 70 bp, Artificial Sequence
  Synthetic
gccaagcatttaggtgacactatagacatgacattttgaaacagcgtttcagagctatgctggaaacagc

SEQ ID NO: 55865 - DNA, 70 bp, Artificial Sequence
  Synthetic
gccaagcatttaggtgacactatagcattaccctgacctggactcgtttcagagctatgctggaaacagc

SEQ ID NO: 55866 - DNA, 70 bp, Artificial Sequence
  Synthetic
gccaagcatttaggtgacactataggacattgtcaaagagctgcagtttcagagctatgctggaaacagc

SEQ ID NO: 55867 - DNA, 70 bp, Artificial Sequence
  Synthetic
gccaagcatttaggtgacactataggctgtttgagaatgtcatctgtttcagagctatgctggaaacagc

SEQ ID NO: 55868 - DNA, 70 bp, Artificial Sequence
  Synthetic
gccaagcatttaggtgacactatagcacattttcaaagagctgcagtttcagagctatgctggaaacagc

SEQ ID NO: 55869 - DNA, 70 bp, Artificial Sequence
  Synthetic
gccaagcatttaggtgacactataggacttctgacaagatgaagtgtttcagagctatgctggaaacagc

SEQ ID NO: 55870 - DNA, 70 bp, Artificial Sequence
  Synthetic
gccaagcatttaggtgacactatagcattgctgatgcgcacactagtttcagagctatgctggaaacagc

SEQ ID NO: 55871 - DNA, 70 bp, Artificial Sequence
  Synthetic
gccaagcatttaggtgacactataggagagaccatggctcaggacgtttcagagctatgctggaaacagc

SEQ ID NO: 55872 - DNA, 70 bp, Artificial Sequence
  Synthetic
gccaagcatttaggtgacactatagggagcagcggccctacagacgtttcagagctatgctggaaacagc

SEQ ID NO: 55873 - DNA, 70 bp, Artificial Sequence
  Synthetic
gccaagcatttaggtgacactataggacctggatatccacatcaagtttcagagctatgctggaaacagc

SEQ ID NO: 55874 - DNA, 70 bp, Artificial Sequence
  Synthetic
gccaagcatttaggtgacactataggacatcagtttgcatcatgggtttcagagctatgctggaaacagc

SEQ ID NO: 55875 - DNA, 70 bp, Artificial Sequence
  Synthetic
gccaagcatttaggtgacactatagatcagagggaaagagaactggtttcagagctatgctggaaacagc

SEQ ID NO: 55876 - DNA, 70 bp, Artificial Sequence
  Synthetic
gccaagcatttaggtgacactataggtcaggagagctttctgatagtttcagagctatgctggaaacagc

SEQ ID NO: 55877 - DNA, 70 bp, Artificial Sequence
  Synthetic
gccaagcatttaggtgacactatagagcagcggccctacagacgggtttcagagctatgctggaaacagc

SEQ ID NO: 55878 - DNA, 70 bp, Artificial Sequence
  Synthetic
gccaagcatttaggtgacactatagcaggcccttacggcgagagtgtttcagagctatgctggaaacagc

SEQ ID NO: 55879 - DNA, 70 bp, Artificial Sequence
  Synthetic
gccaagcatttaggtgacactatagcagcttgcagcgaatctgcggtttcagagctatgctggaaacagc

SEQ ID NO: 55880 - DNA, 70 bp, Artificial Sequence
  Synthetic
gccaagcatttaggtgacactataggaaggcattgtggaaacaacgtttcagagctatgctggaaacagc

SEQ ID NO: 55881 - DNA, 70 bp, Artificial Sequence
  Synthetic
gccaagcatttaggtgacactataggaggagcagctaggatggaagtttcagagctatgctggaaacagc

SEQ ID NO: 55882 - DNA, 70 bp, Artificial Sequence
  Synthetic
gccaagcatttaggtgacactatagttctcagacgagttactccggtttcagagctatgctggaaacagc

SEQ ID NO: 55883 - DNA, 70 bp, Artificial Sequence
  Synthetic
gccaagcatttaggtgacactatagggccgggcctggaggtcagagtttcagagctatgctggaaacagc

SEQ ID NO: 55884 - DNA, 70 bp, Artificial Sequence
  Synthetic
gccaagcatttaggtgacactatagggccaggggctcggtgtgaggtttcagagctatgctggaaacagc

SEQ ID NO: 55885 - DNA, 70 bp, Artificial Sequence
  Synthetic
gccaagcatttaggtgacactatagccagctagggcactaaacttgtttcagagctatgctggaaacagc

SEQ ID NO: 55886 - DNA, 70 bp, Artificial Sequence
  Synthetic
gccaagcatttaggtgacactataggtgcaatttatgactccagagtttcagagctatgctggaaacagc

SEQ ID NO: 55887 - DNA, 70 bp, Artificial Sequence
  Synthetic
gccaagcatttaggtgacactatagggaggaagctggtcacacctgtttcagagctatgctggaaacagc

SEQ ID NO: 55888 - DNA, 70 bp, Artificial Sequence
  Synthetic
gccaagcatttaggtgacactataggcaacaaatcctacgctcaagtttcagagctatgctggaaacagc

SEQ ID NO: 55889 - DNA, 70 bp, Artificial Sequence
  Synthetic
gccaagcatttaggtgacactatagtcaagtaatgagttgttctcgtttcagagctatgctggaaacagc

SEQ ID NO: 55890 - DNA, 70 bp, Artificial Sequence
  Synthetic
gccaagcatttaggtgacactataggggcggacgggcggtctaccgtttcagagctatgctggaaacagc

SEQ ID NO: 55891 - DNA, 70 bp, Artificial Sequence
  Synthetic
gccaagcatttaggtgacactatagtggcagagaccagtggggacgtttcagagctatgctggaaacagc

SEQ ID NO: 55892 - DNA, 70 bp, Artificial Sequence
  Synthetic
gccaagcatttaggtgacactataggcctgggtggggttgtcagagtttcagagctatgctggaaacagc

SEQ ID NO: 55893 - DNA, 70 bp, Artificial Sequence
  Synthetic
gccaagcatttaggtgacactatagaagaaaggactgggaagctggtttcagagctatgctggaaacagc

SEQ ID NO: 55894 - DNA, 70 bp, Artificial Sequence
  Synthetic
gccaagcatttaggtgacactatagaagatccccatctctgcatggtttcagagctatgctggaaacagc

SEQ ID NO: 55895 - DNA, 70 bp, Artificial Sequence
  Synthetic
gccaagcatttaggtgacactatagggttcctctgcacaggtctggtttcagagctatgctggaaacagc

SEQ ID NO: 55896 - DNA, 70 bp, Artificial Sequence
  Synthetic
gccaagcatttaggtgacactatagagatttctggccgggcacgggtttcagagctatgctggaaacagc

SEQ ID NO: 55897 - DNA, 70 bp, Artificial Sequence
  Synthetic
gccaagcatttaggtgacactatagtcacgctgcaggctgtggcagtttcagagctatgctggaaacagc

SEQ ID NO: 55898 - DNA, 70 bp, Artificial Sequence
  Synthetic
gccaagcatttaggtgacactatagctttcaagttggtgcaaaacgtttcagagctatgctggaaacagc

SEQ ID NO: 55899 - DNA, 70 bp, Artificial Sequence
  Synthetic
gccaagcatttaggtgacactatagggtttgacgccacactgtgcgtttcagagctatgctggaaacagc

SEQ ID NO: 55900 - DNA, 70 bp, Artificial Sequence
  Synthetic
gccaagcatttaggtgacactatagggcccctcggggcagtcacagtttcagagctatgctggaaacagc

SEQ ID NO: 55901 - DNA, 70 bp, Artificial Sequence
  Synthetic
gccaagcatttaggtgacactatagacaaaggcgtgccggtgtaggtttcagagctatgctggaaacagc

SEQ ID NO: 55902 - DNA, 70 bp, Artificial Sequence
  Synthetic
gccaagcatttaggtgacactatagaacagccccaagggcacatggtttcagagctatgctggaaacagc

SEQ ID NO: 55903 - DNA, 70 bp, Artificial Sequence
  Synthetic
gccaagcatttaggtgacactataggcttccatccccaggtagctgtttcagagctatgctggaaacagc

SEQ ID NO: 55904 - DNA, 70 bp, Artificial Sequence
  Synthetic
gccaagcatttaggtgacactatagatttatgggagtcctagtccgtttcagagctatgctggaaacagc

SEQ ID NO: 55905 - DNA, 70 bp, Artificial Sequence
  Synthetic
gccaagcatttaggtgacactatagcacctgacgcttcagcaagcgtttcagagctatgctggaaacagc

SEQ ID NO: 55906 - DNA, 70 bp, Artificial Sequence
  Synthetic
gccaagcatttaggtgacactatagtccagggcacggcgtgggaggtttcagagctatgctggaaacagc

SEQ ID NO: 55907 - DNA, 70 bp, Artificial Sequence
  Synthetic
gccaagcatttaggtgacactatagtttccctccccacacctaaagtttcagagctatgctggaaacagc

SEQ ID NO: 55908 - DNA, 70 bp, Artificial Sequence
  Synthetic
gccaagcatttaggtgacactataggcccaagtccagggagtcccgtttcagagctatgctggaaacagc

SEQ ID NO: 55909 - DNA, 70 bp, Artificial Sequence
  Synthetic
gccaagcatttaggtgacactatagaccttcgatgtatggttgctgtttcagagctatgctggaaacagc

SEQ ID NO: 55910 - DNA, 70 bp, Artificial Sequence
  Synthetic
gccaagcatttaggtgacactatagagaagtacgtgcaggaagaggtttcagagctatgctggaaacagc

SEQ ID NO: 55911 - DNA, 70 bp, Artificial Sequence
  Synthetic
gccaagcatttaggtgacactatagccactgcgggggcaagacgagtttcagagctatgctggaaacagc

SEQ ID NO: 55912 - DNA, 70 bp, Artificial Sequence
  Synthetic
gccaagcatttaggtgacactataggggaaaaatcctttgggcaagtttcagagctatgctggaaacagc

SEQ ID NO: 55913 - DNA, 70 bp, Artificial Sequence
  Synthetic
gccaagcatttaggtgacactatagtcgaggtggctagatgtcgtgtttcagagctatgctggaaacagc

SEQ ID NO: 55914 - DNA, 70 bp, Artificial Sequence
  Synthetic
gccaagcatttaggtgacactatagtggatggatggctctacttcgtttcagagctatgctggaaacagc

SEQ ID NO: 55915 - DNA, 70 bp, Artificial Sequence
  Synthetic
gccaagcatttaggtgacactatagtactatgtgagaggatccaagtttcagagctatgctggaaacagc

SEQ ID NO: 55916 - DNA, 70 bp, Artificial Sequence
  Synthetic
gccaagcatttaggtgacactatagagagcagagaaatcttaagagtttcagagctatgctggaaacagc

SEQ ID NO: 55917 - DNA, 70 bp, Artificial Sequence
  Synthetic
gccaagcatttaggtgacactatagtgtaggagagctttctgaccgtttcagagctatgctggaaacagc

SEQ ID NO: 55918 - DNA, 70 bp, Artificial Sequence
  Synthetic
gccaagcatttaggtgacactatagaagcgcaagttctcttaaaggtttcagagctatgctggaaacagc

SEQ ID NO: 55919 - DNA, 70 bp, Artificial Sequence
  Synthetic
gccaagcatttaggtgacactatagccccctcggactgcgggtgagtttcagagctatgctggaaacagc

SEQ ID NO: 55920 - DNA, 70 bp, Artificial Sequence
  Synthetic
gccaagcatttaggtgacactatagtagctactctctgatgaagtgtttcagagctatgctggaaacagc

SEQ ID NO: 55921 - DNA, 70 bp, Artificial Sequence
  Synthetic
gccaagcatttaggtgacactatagcaactgcttgaacttgtgtagtttcagagctatgctggaaacagc

SEQ ID NO: 55922 - DNA, 70 bp, Artificial Sequence
  Synthetic
gccaagcatttaggtgacactatagcagccagcagtccaagtagcgtttcagagctatgctggaaacagc

SEQ ID NO: 55923 - DNA, 70 bp, Artificial Sequence
  Synthetic
gccaagcatttaggtgacactatagcccgatgaggggtcctgagggtttcagagctatgctggaaacagc

SEQ ID NO: 55924 - DNA, 70 bp, Artificial Sequence
  Synthetic
gccaagcatttaggtgacactataggccgggcccaggaagtgagggtttcagagctatgctggaaacagc

SEQ ID NO: 55925 - DNA, 70 bp, Artificial Sequence
  Synthetic
gccaagcatttaggtgacactatagaagtggggtttaagaacaaagtttcagagctatgctggaaacagc

SEQ ID NO: 55926 - DNA, 70 bp, Artificial Sequence
  Synthetic
gccaagcatttaggtgacactatagagccagtgacctcttttaaagtttcagagctatgctggaaacagc

SEQ ID NO: 55927 - DNA, 70 bp, Artificial Sequence
  Synthetic
gccaagcatttaggtgacactatagtcagcaccaacatggactgagtttcagagctatgctggaaacagc

SEQ ID NO: 55928 - DNA, 70 bp, Artificial Sequence
  Synthetic
gccaagcatttaggtgacactataggtttgacatgaggcaagctggtttcagagctatgctggaaacagc

SEQ ID NO: 55929 - DNA, 70 bp, Artificial Sequence
  Synthetic
gccaagcatttaggtgacactatagcaccacaacctccgcctctggtttcagagctatgctggaaacagc

SEQ ID NO: 55930 - DNA, 70 bp, Artificial Sequence
  Synthetic
gccaagcatttaggtgacactatagttctttatctgagattgctcgtttcagagctatgctggaaacagc

SEQ ID NO: 55931 - DNA, 70 bp, Artificial Sequence
  Synthetic
gccaagcatttaggtgacactatagccctggttttaatacatctggtttcagagctatgctggaaacagc

SEQ ID NO: 55932 - DNA, 70 bp, Artificial Sequence
  Synthetic
gccaagcatttaggtgacactatagaatgattccctacgttagccgtttcagagctatgctggaaacagc

SEQ ID NO: 55933 - DNA, 70 bp, Artificial Sequence
  Synthetic
gccaagcatttaggtgacactatagaattgcacagcaaaatgagcgtttcagagctatgctggaaacagc

SEQ ID NO: 55934 - DNA, 70 bp, Artificial Sequence
  Synthetic
gccaagcatttaggtgacactatagctgtgtctcgtcgcgagtctgtttcagagctatgctggaaacagc

SEQ ID NO: 55935 - DNA, 70 bp, Artificial Sequence
  Synthetic
gccaagcatttaggtgacactatagcactggtcaagattctcggggtttcagagctatgctggaaacagc

SEQ ID NO: 55936 - DNA, 70 bp, Artificial Sequence
  Synthetic
gccaagcatttaggtgacactataggaatatgggcaggtctataggtttcagagctatgctggaaacagc

SEQ ID NO: 55937 - DNA, 70 bp, Artificial Sequence
  Synthetic
gccaagcatttaggtgacactataggcagcgggggagatgatttcgtttcagagctatgctggaaacagc

SEQ ID NO: 55938 - DNA, 70 bp, Artificial Sequence
  Synthetic
gccaagcatttaggtgacactatagtcttgtcttggggtgagctggtttcagagctatgctggaaacagc

SEQ ID NO: 55939 - DNA, 70 bp, Artificial Sequence
  Synthetic
gccaagcatttaggtgacactatagtaatctttactgccctaggggtttcagagctatgctggaaacagc

SEQ ID NO: 55940 - DNA, 70 bp, Artificial Sequence
  Synthetic
gccaagcatttaggtgacactatagtcctggctcagggtgtctccgtttcagagctatgctggaaacagc

SEQ ID NO: 55941 - DNA, 70 bp, Artificial Sequence
  Synthetic
gccaagcatttaggtgacactataggcaagagcctctggactaaagtttcagagctatgctggaaacagc

SEQ ID NO: 55942 - DNA, 70 bp, Artificial Sequence
  Synthetic
gccaagcatttaggtgacactataggcccacctccaccagtgagcgtttcagagctatgctggaaacagc

SEQ ID NO: 55943 - DNA, 70 bp, Artificial Sequence
  Synthetic
gccaagcatttaggtgacactatagctgcgctttgtccggcactggtttcagagctatgctggaaacagc

SEQ ID NO: 55944 - DNA, 70 bp, Artificial Sequence
  Synthetic
gccaagcatttaggtgacactatagcaccgagtacgtcttctgcagtttcagagctatgctggaaacagc

SEQ ID NO: 55945 - DNA, 70 bp, Artificial Sequence
  Synthetic
gccaagcatttaggtgacactatagtggccaacaaattgtcttcagtttcagagctatgctggaaacagc

SEQ ID NO: 55946 - DNA, 70 bp, Artificial Sequence
  Synthetic
gccaagcatttaggtgacactatagctgccggctcaactcggtacgtttcagagctatgctggaaacagc

SEQ ID NO: 55947 - DNA, 70 bp, Artificial Sequence
  Synthetic
gccaagcatttaggtgacactataggtctcctagcgtccgagagagtttcagagctatgctggaaacagc

SEQ ID NO: 55948 - DNA, 70 bp, Artificial Sequence
  Synthetic
gccaagcatttaggtgacactatagttcctgagagaaaacatcctgtttcagagctatgctggaaacagc

SEQ ID NO: 55949 - DNA, 70 bp, Artificial Sequence
  Synthetic
gccaagcatttaggtgacactataggccagaggcacccggatgtggtttcagagctatgctggaaacagc

SEQ ID NO: 55950 - DNA, 70 bp, Artificial Sequence
  Synthetic
gccaagcatttaggtgacactatagagatcacctccagggacttggtttcagagctatgctggaaacagc

SEQ ID NO: 55951 - DNA, 70 bp, Artificial Sequence
  Synthetic
gccaagcatttaggtgacactatagtgaggctgagcttgcagtgagtttcagagctatgctggaaacagc

SEQ ID NO: 55952 - DNA, 70 bp, Artificial Sequence
  Synthetic
gccaagcatttaggtgacactatagactgagaacgggaagaacaagtttcagagctatgctggaaacagc

SEQ ID NO: 55953 - DNA, 70 bp, Artificial Sequence
  Synthetic
gccaagcatttaggtgacactatagaagtacctacaagaggactagtttcagagctatgctggaaacagc

SEQ ID NO: 55954 - DNA, 70 bp, Artificial Sequence
  Synthetic
gccaagcatttaggtgacactatagttcttcaggagagaggatcggtttcagagctatgctggaaacagc

SEQ ID NO: 55955 - DNA, 70 bp, Artificial Sequence
  Synthetic
gccaagcatttaggtgacactatagtctaacgactttcaggattagtttcagagctatgctggaaacagc

SEQ ID NO: 55956 - DNA, 70 bp, Artificial Sequence
  Synthetic
gccaagcatttaggtgacactatagttcttctcacccacatgctcgtttcagagctatgctggaaacagc

SEQ ID NO: 55957 - DNA, 70 bp, Artificial Sequence
  Synthetic
gccaagcatttaggtgacactatagaaaaagtgattcttcaggtcgtttcagagctatgctggaaacagc

SEQ ID NO: 55958 - DNA, 70 bp, Artificial Sequence
  Synthetic
gccaagcatttaggtgacactataggctgtgaacaattgacccttgtttcagagctatgctggaaacagc

SEQ ID NO: 55959 - DNA, 70 bp, Artificial Sequence
  Synthetic
gccaagcatttaggtgacactatagaacgaggctcaaggatgtgagtttcagagctatgctggaaacagc

SEQ ID NO: 55960 - DNA, 70 bp, Artificial Sequence
  Synthetic
gccaagcatttaggtgacactataggagatcagtcgtctgtcttcgtttcagagctatgctggaaacagc

SEQ ID NO: 55961 - DNA, 70 bp, Artificial Sequence
  Synthetic
gccaagcatttaggtgacactatagatgagttcaagatcacatgggtttcagagctatgctggaaacagc

SEQ ID NO: 55962 - DNA, 70 bp, Artificial Sequence
  Synthetic
gccaagcatttaggtgacactatagtctatgagttcaagatcacagtttcagagctatgctggaaacagc

SEQ ID NO: 55963 - DNA, 70 bp, Artificial Sequence
  Synthetic
gccaagcatttaggtgacactatagctgaactgttgcagaagtatgtttcagagctatgctggaaacagc

SEQ ID NO: 55964 - DNA, 70 bp, Artificial Sequence
  Synthetic
gccaagcatttaggtgacactatagacactttgtgacatgtgtaggtttcagagctatgctggaaacagc

SEQ ID NO: 55965 - DNA, 70 bp, Artificial Sequence
  Synthetic
gccaagcatttaggtgacactatagtgcatatcagagttcatcttgtttcagagctatgctggaaacagc

SEQ ID NO: 55966 - DNA, 70 bp, Artificial Sequence
  Synthetic
gccaagcatttaggtgacactatagactcaaagttcttctcttgagtttcagagctatgctggaaacagc

SEQ ID NO: 55967 - DNA, 70 bp, Artificial Sequence
  Synthetic
gccaagcatttaggtgacactatagggagaggaccggggctatgcgtttcagagctatgctggaaacagc

SEQ ID NO: 55968 - DNA, 70 bp, Artificial Sequence
  Synthetic
gccaagcatttaggtgacactatagatggtctttggcacttatgcgtttcagagctatgctggaaacagc

SEQ ID NO: 55969 - DNA, 70 bp, Artificial Sequence
  Synthetic
gccaagcatttaggtgacactatagtgcattaaacagaaaccttcgtttcagagctatgctggaaacagc

SEQ ID NO: 55970 - DNA, 70 bp, Artificial Sequence
  Synthetic
gccaagcatttaggtgacactataggtctctgaaggtcctcagatgtttcagagctatgctggaaacagc

SEQ ID NO: 55971 - DNA, 70 bp, Artificial Sequence
  Synthetic
gccaagcatttaggtgacactatagaaatggatgagtaactccttgtttcagagctatgctggaaacagc

SEQ ID NO: 55972 - DNA, 70 bp, Artificial Sequence
  Synthetic
gccaagcatttaggtgacactataggcaggggttagcagtacaccgtttcagagctatgctggaaacagc

SEQ ID NO: 55973 - DNA, 70 bp, Artificial Sequence
  Synthetic
gccaagcatttaggtgacactatagatgcatctgtctcacatgctgtttcagagctatgctggaaacagc

SEQ ID NO: 55974 - DNA, 70 bp, Artificial Sequence
  Synthetic
gccaagcatttaggtgacactataggttacaggggcatatttgaggtttcagagctatgctggaaacagc

SEQ ID NO: 55975 - DNA, 70 bp, Artificial Sequence
  Synthetic
gccaagcatttaggtgacactataggtatcagcttctcgtcagacgtttcagagctatgctggaaacagc

SEQ ID NO: 55976 - DNA, 70 bp, Artificial Sequence
  Synthetic
gccaagcatttaggtgacactatagcggctcactcatcccccaaagtttcagagctatgctggaaacagc

SEQ ID NO: 55977 - DNA, 70 bp, Artificial Sequence
  Synthetic
gccaagcatttaggtgacactatagtggactaactcagtttttgcgtttcagagctatgctggaaacagc

SEQ ID NO: 55978 - DNA, 70 bp, Artificial Sequence
  Synthetic
gccaagcatttaggtgacactatagagattaaggtttgccaaaacgtttcagagctatgctggaaacagc

SEQ ID NO: 55979 - DNA, 70 bp, Artificial Sequence
  Synthetic
gccaagcatttaggtgacactatagatccaaactggcaaggtcctgtttcagagctatgctggaaacagc

SEQ ID NO: 55980 - DNA, 70 bp, Artificial Sequence
  Synthetic
gccaagcatttaggtgacactatagataccgggccatcatggagtgtttcagagctatgctggaaacagc

SEQ ID NO: 55981 - DNA, 70 bp, Artificial Sequence
  Synthetic
gccaagcatttaggtgacactataggagcggccagctgtcctagagtttcagagctatgctggaaacagc

SEQ ID NO: 55982 - DNA, 70 bp, Artificial Sequence
  Synthetic
gccaagcatttaggtgacactatagtggagcagacattatccaaggtttcagagctatgctggaaacagc

SEQ ID NO: 55983 - DNA, 70 bp, Artificial Sequence
  Synthetic
gccaagcatttaggtgacactatagatgcagactactgtctcttcgtttcagagctatgctggaaacagc

SEQ ID NO: 55984 - DNA, 70 bp, Artificial Sequence
  Synthetic
gccaagcatttaggtgacactatagtaatgggagcatatatgatggtttcagagctatgctggaaacagc

SEQ ID NO: 55985 - DNA, 70 bp, Artificial Sequence
  Synthetic
gccaagcatttaggtgacactatagtaggcagaatacctttacaggtttcagagctatgctggaaacagc

SEQ ID NO: 55986 - DNA, 70 bp, Artificial Sequence
  Synthetic
gccaagcatttaggtgacactatagagcccgtggacttagggcacgtttcagagctatgctggaaacagc

SEQ ID NO: 55987 - DNA, 70 bp, Artificial Sequence
  Synthetic
gccaagcatttaggtgacactatagtgctgaaggccaccactcaagtttcagagctatgctggaaacagc

SEQ ID NO: 55988 - DNA, 70 bp, Artificial Sequence
  Synthetic
gccaagcatttaggtgacactatagctaaccaagcatctgctaacgtttcagagctatgctggaaacagc

SEQ ID NO: 55989 - DNA, 70 bp, Artificial Sequence
  Synthetic
gccaagcatttaggtgacactatagttgtgtttttactttcggctgtttcagagctatgctggaaacagc

SEQ ID NO: 55990 - DNA, 70 bp, Artificial Sequence
  Synthetic
gccaagcatttaggtgacactatagaatgctggttagaggctaccgtttcagagctatgctggaaacagc

SEQ ID NO: 55991 - DNA, 70 bp, Artificial Sequence
  Synthetic
gccaagcatttaggtgacactatagaggcctcccagagagaatcggtttcagagctatgctggaaacagc

SEQ ID NO: 55992 - DNA, 70 bp, Artificial Sequence
  Synthetic
gccaagcatttaggtgacactatagcactgtcacaactgttgctggtttcagagctatgctggaaacagc

SEQ ID NO: 55993 - DNA, 70 bp, Artificial Sequence
  Synthetic
gccaagcatttaggtgacactatagggttatgcccctgatgaatggtttcagagctatgctggaaacagc

SEQ ID NO: 55994 - DNA, 70 bp, Artificial Sequence
  Synthetic
gccaagcatttaggtgacactatagcaactgttgctcatcagagtgtttcagagctatgctggaaacagc

SEQ ID NO: 55995 - DNA, 70 bp, Artificial Sequence
  Synthetic
gccaagcatttaggtgacactatagggaacaatatcaagatgagggtttcagagctatgctggaaacagc

SEQ ID NO: 55996 - DNA, 70 bp, Artificial Sequence
  Synthetic
gccaagcatttaggtgacactatagccagccagcacgtcgcgatggtttcagagctatgctggaaacagc

SEQ ID NO: 55997 - DNA, 70 bp, Artificial Sequence
  Synthetic
gccaagcatttaggtgacactataggtcacacaaagaaacgtgcagtttcagagctatgctggaaacagc

SEQ ID NO: 55998 - DNA, 70 bp, Artificial Sequence
  Synthetic
gccaagcatttaggtgacactatagagcttctggtggtcgtagccgtttcagagctatgctggaaacagc

SEQ ID NO: 55999 - DNA, 70 bp, Artificial Sequence
  Synthetic
gccaagcatttaggtgacactataggagctctcctcctgtttaaagtttcagagctatgctggaaacagc

SEQ ID NO: 56000 - DNA, 70 bp, Artificial Sequence
  Synthetic
gccaagcatttaggtgacactatagctatgctgtcaaaacttccagtttcagagctatgctggaaacagc

SEQ ID NO: 56001 - DNA, 70 bp, Artificial Sequence
  Synthetic
gccaagcatttaggtgacactatagagaaacaaaagtgcctcaacgtttcagagctatgctggaaacagc

SEQ ID NO: 56002 - DNA, 70 bp, Artificial Sequence
  Synthetic
gccaagcatttaggtgacactatagcgctgccagctctggtaactgtttcagagctatgctggaaacagc

SEQ ID NO: 56003 - DNA, 70 bp, Artificial Sequence
  Synthetic
gccaagcatttaggtgacactataggacctgcttcagacttctgcgtttcagagctatgctggaaacagc

SEQ ID NO: 56004 - DNA, 70 bp, Artificial Sequence
  Synthetic
gccaagcatttaggtgacactatagacggatacagtgaactcaaagtttcagagctatgctggaaacagc

SEQ ID NO: 56005 - DNA, 70 bp, Artificial Sequence
  Synthetic
gccaagcatttaggtgacactatagtcccaggggagatcagtctcgtttcagagctatgctggaaacagc

SEQ ID NO: 56006 - DNA, 70 bp, Artificial Sequence
  Synthetic
gccaagcatttaggtgacactatagacccagttactagattatgagtttcagagctatgctggaaacagc

SEQ ID NO: 56007 - DNA, 70 bp, Artificial Sequence
  Synthetic
gccaagcatttaggtgacactataggcatacagagagcacccatagtttcagagctatgctggaaacagc

SEQ ID NO: 56008 - DNA, 70 bp, Artificial Sequence
  Synthetic
gccaagcatttaggtgacactatagacccctatggtagatattgagtttcagagctatgctggaaacagc

SEQ ID NO: 56009 - DNA, 70 bp, Artificial Sequence
  Synthetic
gccaagcatttaggtgacactatagtacaatcagtatctgccatagtttcagagctatgctggaaacagc

SEQ ID NO: 56010 - DNA, 70 bp, Artificial Sequence
  Synthetic
gccaagcatttaggtgacactatagtgtggcctgcagggctttgagtttcagagctatgctggaaacagc

SEQ ID NO: 56011 - DNA, 70 bp, Artificial Sequence
  Synthetic
gccaagcatttaggtgacactatagctcaaaagttaagactgagcgtttcagagctatgctggaaacagc

SEQ ID NO: 56012 - DNA, 70 bp, Artificial Sequence
  Synthetic
gccaagcatttaggtgacactatagcacgcagcagggacagcagcgtttcagagctatgctggaaacagc

SEQ ID NO: 56013 - DNA, 70 bp, Artificial Sequence
  Synthetic
gccaagcatttaggtgacactatagtgagtggtttatggaatagagtttcagagctatgctggaaacagc

SEQ ID NO: 56014 - DNA, 70 bp, Artificial Sequence
  Synthetic
gccaagcatttaggtgacactataggttcacctgttctaaagcaagtttcagagctatgctggaaacagc

SEQ ID NO: 56015 - DNA, 70 bp, Artificial Sequence
  Synthetic
gccaagcatttaggtgacactatagtttggcaggcgcaaatgattgtttcagagctatgctggaaacagc

SEQ ID NO: 56016 - DNA, 70 bp, Artificial Sequence
  Synthetic
gccaagcatttaggtgacactataggtaagactaggttttggctagtttcagagctatgctggaaacagc

SEQ ID NO: 56017 - DNA, 70 bp, Artificial Sequence
  Synthetic
gccaagcatttaggtgacactatagagtgttgtaagactaggtttgtttcagagctatgctggaaacagc

SEQ ID NO: 56018 - DNA, 70 bp, Artificial Sequence
  Synthetic
gccaagcatttaggtgacactataggtgggtgggccctagtgaaggtttcagagctatgctggaaacagc

SEQ ID NO: 56019 - DNA, 70 bp, Artificial Sequence
  Synthetic
gccaagcatttaggtgacactatagaacaggaaagaatggaactggtttcagagctatgctggaaacagc

SEQ ID NO: 56020 - DNA, 70 bp, Artificial Sequence
  Synthetic
gccaagcatttaggtgacactatagattgctcaaaggacagataagtttcagagctatgctggaaacagc

SEQ ID NO: 56021 - DNA, 70 bp, Artificial Sequence
  Synthetic
gccaagcatttaggtgacactataggagacagaccaggtggctacgtttcagagctatgctggaaacagc

SEQ ID NO: 56022 - DNA, 70 bp, Artificial Sequence
  Synthetic
gccaagcatttaggtgacactatagggctggcctggggtcagtacgtttcagagctatgctggaaacagc

SEQ ID NO: 56023 - DNA, 70 bp, Artificial Sequence
  Synthetic
gccaagcatttaggtgacactatagagacagcagacctgaactgcgtttcagagctatgctggaaacagc

SEQ ID NO: 56024 - DNA, 70 bp, Artificial Sequence
  Synthetic
gccaagcatttaggtgacactatagagaatctctatgtcttttgggtttcagagctatgctggaaacagc

SEQ ID NO: 56025 - DNA, 70 bp, Artificial Sequence
  Synthetic
gccaagcatttaggtgacactatagtctgcgatccgaagcattgagtttcagagctatgctggaaacagc

SEQ ID NO: 56026 - DNA, 70 bp, Artificial Sequence
  Synthetic
gccaagcatttaggtgacactatagaagcaacagcccatctggtagtttcagagctatgctggaaacagc

SEQ ID NO: 56027 - DNA, 70 bp, Artificial Sequence
  Synthetic
gccaagcatttaggtgacactatagtgagcaaatggccactgagtgtttcagagctatgctggaaacagc

SEQ ID NO: 56028 - DNA, 70 bp, Artificial Sequence
  Synthetic
gccaagcatttaggtgacactataggagacgacggcgctgctgacgtttcagagctatgctggaaacagc

SEQ ID NO: 56029 - DNA, 70 bp, Artificial Sequence
  Synthetic
gccaagcatttaggtgacactatagacacgtaggtaactttgtgagtttcagagctatgctggaaacagc

SEQ ID NO: 56030 - DNA, 70 bp, Artificial Sequence
  Synthetic
gccaagcatttaggtgacactatagcagcacagtgtttatgccacgtttcagagctatgctggaaacagc

SEQ ID NO: 56031 - DNA, 70 bp, Artificial Sequence
  Synthetic
gccaagcatttaggtgacactatagggggcagataccttctgaacgtttcagagctatgctggaaacagc

SEQ ID NO: 56032 - DNA, 70 bp, Artificial Sequence
  Synthetic
gccaagcatttaggtgacactatagtcttagaggctgctacataagtttcagagctatgctggaaacagc

SEQ ID NO: 56033 - DNA, 70 bp, Artificial Sequence
  Synthetic
gccaagcatttaggtgacactatagtgccatttctcatcaccaccgtttcagagctatgctggaaacagc

SEQ ID NO: 56034 - DNA, 70 bp, Artificial Sequence
  Synthetic
gccaagcatttaggtgacactatagagaggagcagtgcatgctttgtttcagagctatgctggaaacagc

SEQ ID NO: 56035 - DNA, 70 bp, Artificial Sequence
  Synthetic
gccaagcatttaggtgacactatagttctgcctcagataacataggtttcagagctatgctggaaacagc

SEQ ID NO: 56036 - DNA, 70 bp, Artificial Sequence
  Synthetic
gccaagcatttaggtgacactatagagtgaatgaactgactgacagtttcagagctatgctggaaacagc

SEQ ID NO: 56037 - DNA, 70 bp, Artificial Sequence
  Synthetic
gccaagcatttaggtgacactatagagccctcaacggacatcagtgtttcagagctatgctggaaacagc

SEQ ID NO: 56038 - DNA, 70 bp, Artificial Sequence
  Synthetic
gccaagcatttaggtgacactataggccattctggatggctccctgtttcagagctatgctggaaacagc

SEQ ID NO: 56039 - DNA, 70 bp, Artificial Sequence
  Synthetic
gccaagcatttaggtgacactatagccgcacgcggctaggtcatcgtttcagagctatgctggaaacagc

SEQ ID NO: 56040 - DNA, 70 bp, Artificial Sequence
  Synthetic
gccaagcatttaggtgacactatagtcatgatttcattgtgcagagtttcagagctatgctggaaacagc

SEQ ID NO: 56041 - DNA, 70 bp, Artificial Sequence
  Synthetic
gccaagcatttaggtgacactatagagtcactatggtaaccaagagtttcagagctatgctggaaacagc

SEQ ID NO: 56042 - DNA, 70 bp, Artificial Sequence
  Synthetic
gccaagcatttaggtgacactatagcgagtggacaattctggaacgtttcagagctatgctggaaacagc

SEQ ID NO: 56043 - DNA, 70 bp, Artificial Sequence
  Synthetic
gccaagcatttaggtgacactatagtactgcactacaggatgaaagtttcagagctatgctggaaacagc

SEQ ID NO: 56044 - DNA, 70 bp, Artificial Sequence
  Synthetic
gccaagcatttaggtgacactatagcttcgttgtcaaaagaaagggtttcagagctatgctggaaacagc

SEQ ID NO: 56045 - DNA, 70 bp, Artificial Sequence
  Synthetic
gccaagcatttaggtgacactataggaaataaaggctgccaaagcgtttcagagctatgctggaaacagc

SEQ ID NO: 56046 - DNA, 70 bp, Artificial Sequence
  Synthetic
gccaagcatttaggtgacactataggtcctgttggctcctcctacgtttcagagctatgctggaaacagc

SEQ ID NO: 56047 - DNA, 70 bp, Artificial Sequence
  Synthetic
gccaagcatttaggtgacactatagaagagggctctagaagccaggtttcagagctatgctggaaacagc

SEQ ID NO: 56048 - DNA, 70 bp, Artificial Sequence
  Synthetic
gccaagcatttaggtgacactatagattgcgtgatttctgccatggtttcagagctatgctggaaacagc

SEQ ID NO: 56049 - DNA, 70 bp, Artificial Sequence
  Synthetic
gccaagcatttaggtgacactatagccaaaaggaaagcaaaggctgtttcagagctatgctggaaacagc

SEQ ID NO: 56050 - DNA, 70 bp, Artificial Sequence
  Synthetic
gccaagcatttaggtgacactataggccccagattataaaatagggtttcagagctatgctggaaacagc

SEQ ID NO: 56051 - DNA, 70 bp, Artificial Sequence
  Synthetic
gccaagcatttaggtgacactatagggatccccgccaatatcgtcgtttcagagctatgctggaaacagc

SEQ ID NO: 56052 - DNA, 70 bp, Artificial Sequence
  Synthetic
gccaagcatttaggtgacactatagttaagaggtttcttttgctggtttcagagctatgctggaaacagc

SEQ ID NO: 56053 - DNA, 70 bp, Artificial Sequence
  Synthetic
gccaagcatttaggtgacactataggtggccagaacggccataaggtttcagagctatgctggaaacagc

SEQ ID NO: 56054 - DNA, 70 bp, Artificial Sequence
  Synthetic
gccaagcatttaggtgacactatagggtctgtgctgctcaggagagtttcagagctatgctggaaacagc

SEQ ID NO: 56055 - DNA, 70 bp, Artificial Sequence
  Synthetic
gccaagcatttaggtgacactatagaggcaggcagtgcctctcacgtttcagagctatgctggaaacagc

SEQ ID NO: 56056 - DNA, 70 bp, Artificial Sequence
  Synthetic
gccaagcatttaggtgacactatagctctttcagaggactcctgagtttcagagctatgctggaaacagc

SEQ ID NO: 56057 - DNA, 70 bp, Artificial Sequence
  Synthetic
gccaagcatttaggtgacactatagtcatatatttggggatcttggtttcagagctatgctggaaacagc

SEQ ID NO: 56058 - DNA, 70 bp, Artificial Sequence
  Synthetic
gccaagcatttaggtgacactataggttggaggagaatcagattcgtttcagagctatgctggaaacagc

SEQ ID NO: 56059 - DNA, 70 bp, Artificial Sequence
  Synthetic
gccaagcatttaggtgacactatagaaagagaggttgtgattgatgtttcagagctatgctggaaacagc

SEQ ID NO: 56060 - DNA, 70 bp, Artificial Sequence
  Synthetic
gccaagcatttaggtgacactatagcagatgtttacggactgacagtttcagagctatgctggaaacagc

SEQ ID NO: 56061 - DNA, 70 bp, Artificial Sequence
  Synthetic
gccaagcatttaggtgacactatagctgaaatacattggccaacagtttcagagctatgctggaaacagc

SEQ ID NO: 56062 - DNA, 70 bp, Artificial Sequence
  Synthetic
gccaagcatttaggtgacactataggaggagaagatgggcctcccgtttcagagctatgctggaaacagc

SEQ ID NO: 56063 - DNA, 70 bp, Artificial Sequence
  Synthetic
gccaagcatttaggtgacactatagtgcgctggatcatctccgaggtttcagagctatgctggaaacagc

SEQ ID NO: 56064 - DNA, 70 bp, Artificial Sequence
  Synthetic
gccaagcatttaggtgacactataggcagaacttccacagctgatgtttcagagctatgctggaaacagc

SEQ ID NO: 56065 - DNA, 70 bp, Artificial Sequence
  Synthetic
gccaagcatttaggtgacactatagcggggctaaggcgttagaccgtttcagagctatgctggaaacagc

SEQ ID NO: 56066 - DNA, 70 bp, Artificial Sequence
  Synthetic
gccaagcatttaggtgacactatagattttacaggactgctaccagtttcagagctatgctggaaacagc

SEQ ID NO: 56067 - DNA, 70 bp, Artificial Sequence
  Synthetic
gccaagcatttaggtgacactatagagtcttccatgagaatcaatgtttcagagctatgctggaaacagc

SEQ ID NO: 56068 - DNA, 70 bp, Artificial Sequence
  Synthetic
gccaagcatttaggtgacactatagtcagaggcttttctggtcttgtttcagagctatgctggaaacagc

SEQ ID NO: 56069 - DNA, 70 bp, Artificial Sequence
  Synthetic
gccaagcatttaggtgacactataggaactctggaaggtcatcaggtttcagagctatgctggaaacagc

SEQ ID NO: 56070 - DNA, 70 bp, Artificial Sequence
  Synthetic
gccaagcatttaggtgacactatagtatgagaaccaagtttgaccgtttcagagctatgctggaaacagc

SEQ ID NO: 56071 - DNA, 70 bp, Artificial Sequence
  Synthetic
gccaagcatttaggtgacactatagcatgcattggcctggcatctgtttcagagctatgctggaaacagc

SEQ ID NO: 56072 - DNA, 70 bp, Artificial Sequence
  Synthetic
gccaagcatttaggtgacactatagtgaaggggcctctcagctaggtttcagagctatgctggaaacagc

SEQ ID NO: 56073 - DNA, 70 bp, Artificial Sequence
  Synthetic
gccaagcatttaggtgacactatagtctaaaagtcgttttggtcagtttcagagctatgctggaaacagc

SEQ ID NO: 56074 - DNA, 70 bp, Artificial Sequence
  Synthetic
gccaagcatttaggtgacactatagtctaagagcaacagaaaaaggtttcagagctatgctggaaacagc

SEQ ID NO: 56075 - DNA, 70 bp, Artificial Sequence
  Synthetic
gccaagcatttaggtgacactataggggccccagtgggggctcacgtttcagagctatgctggaaacagc

SEQ ID NO: 56076 - DNA, 70 bp, Artificial Sequence
  Synthetic
gccaagcatttaggtgacactatagtgtgtggtctttgagcccgtgtttcagagctatgctggaaacagc

SEQ ID NO: 56077 - DNA, 70 bp, Artificial Sequence
  Synthetic
gccaagcatttaggtgacactatagctacaaatacccaggccttagtttcagagctatgctggaaacagc

SEQ ID NO: 56078 - DNA, 70 bp, Artificial Sequence
  Synthetic
gccaagcatttaggtgacactatagctgttagttcactcagacacgtttcagagctatgctggaaacagc

SEQ ID NO: 56079 - DNA, 70 bp, Artificial Sequence
  Synthetic
gccaagcatttaggtgacactatagattcaagatgcagctctgtcgtttcagagctatgctggaaacagc

SEQ ID NO: 56080 - DNA, 70 bp, Artificial Sequence
  Synthetic
gccaagcatttaggtgacactatagagtgttagttgccatgttgagtttcagagctatgctggaaacagc

SEQ ID NO: 56081 - DNA, 70 bp, Artificial Sequence
  Synthetic
gccaagcatttaggtgacactatagtcttctgagagcacaggcttgtttcagagctatgctggaaacagc

SEQ ID NO: 56082 - DNA, 70 bp, Artificial Sequence
  Synthetic
gccaagcatttaggtgacactatagtgagatagatagctcttcaggtttcagagctatgctggaaacagc

SEQ ID NO: 56083 - DNA, 70 bp, Artificial Sequence
  Synthetic
gccaagcatttaggtgacactatagccaacccccaagtgaattaagtttcagagctatgctggaaacagc

SEQ ID NO: 56084 - DNA, 70 bp, Artificial Sequence
  Synthetic
gccaagcatttaggtgacactatagggttcccacttggccttcaagtttcagagctatgctggaaacagc

SEQ ID NO: 56085 - DNA, 70 bp, Artificial Sequence
  Synthetic
gccaagcatttaggtgacactatagatctctaattccagcactttgtttcagagctatgctggaaacagc

SEQ ID NO: 56086 - DNA, 70 bp, Artificial Sequence
  Synthetic
gccaagcatttaggtgacactatagtgcttgctgctctcaccgtggtttcagagctatgctggaaacagc

SEQ ID NO: 56087 - DNA, 70 bp, Artificial Sequence
  Synthetic
gccaagcatttaggtgacactatagttgacagcacagaacccaaagtttcagagctatgctggaaacagc

SEQ ID NO: 56088 - DNA, 70 bp, Artificial Sequence
  Synthetic
gccaagcatttaggtgacactatagccctaaggcagcggctcagcgtttcagagctatgctggaaacagc

SEQ ID NO: 56089 - DNA, 70 bp, Artificial Sequence
  Synthetic
gccaagcatttaggtgacactatagcacacccagtaggattcagtgtttcagagctatgctggaaacagc

SEQ ID NO: 56090 - DNA, 70 bp, Artificial Sequence
  Synthetic
gccaagcatttaggtgacactatagggaaaatgtcaggcttgctggtttcagagctatgctggaaacagc

SEQ ID NO: 56091 - DNA, 70 bp, Artificial Sequence
  Synthetic
gccaagcatttaggtgacactatagactacagcagccacgggacggtttcagagctatgctggaaacagc

SEQ ID NO: 56092 - DNA, 70 bp, Artificial Sequence
  Synthetic
gccaagcatttaggtgacactatagcatttgacaagactctaagggtttcagagctatgctggaaacagc

SEQ ID NO: 56093 - DNA, 70 bp, Artificial Sequence
  Synthetic
gccaagcatttaggtgacactataggcaagcagctgtgctcacaggtttcagagctatgctggaaacagc

SEQ ID NO: 56094 - DNA, 70 bp, Artificial Sequence
  Synthetic
gccaagcatttaggtgacactatagattatcttgtcgaacacgttgtttcagagctatgctggaaacagc

SEQ ID NO: 56095 - DNA, 70 bp, Artificial Sequence
  Synthetic
gccaagcatttaggtgacactatagctcccaggtgactggcactagtttcagagctatgctggaaacagc

SEQ ID NO: 56096 - DNA, 70 bp, Artificial Sequence
  Synthetic
gccaagcatttaggtgacactatagttctggcggtcaggacacctgtttcagagctatgctggaaacagc

SEQ ID NO: 56097 - DNA, 70 bp, Artificial Sequence
  Synthetic
gccaagcatttaggtgacactatagatgctcccggcataactgaggtttcagagctatgctggaaacagc

SEQ ID NO: 56098 - DNA, 70 bp, Artificial Sequence
  Synthetic
gccaagcatttaggtgacactatagctcaggttcagacccgcatcgtttcagagctatgctggaaacagc

SEQ ID NO: 56099 - DNA, 70 bp, Artificial Sequence
  Synthetic
gccaagcatttaggtgacactataggagtcacttagtatttcgacgtttcagagctatgctggaaacagc

SEQ ID NO: 56100 - DNA, 70 bp, Artificial Sequence
  Synthetic
gccaagcatttaggtgacactatagtcagcacccaatctcaaagcgtttcagagctatgctggaaacagc

SEQ ID NO: 56101 - DNA, 70 bp, Artificial Sequence
  Synthetic
gccaagcatttaggtgacactatagggattaagtcagggccatctgtttcagagctatgctggaaacagc

SEQ ID NO: 56102 - DNA, 70 bp, Artificial Sequence
  Synthetic
gccaagcatttaggtgacactatagccctgacctcaaggagagtggtttcagagctatgctggaaacagc

SEQ ID NO: 56103 - DNA, 70 bp, Artificial Sequence
  Synthetic
gccaagcatttaggtgacactatagttactcaaatctgggcctttgtttcagagctatgctggaaacagc

SEQ ID NO: 56104 - DNA, 70 bp, Artificial Sequence
  Synthetic
gccaagcatttaggtgacactataggaagtcgtcgtttgataatcgtttcagagctatgctggaaacagc

SEQ ID NO: 56105 - DNA, 70 bp, Artificial Sequence
  Synthetic
gccaagcatttaggtgacactatagctctgacacaggagatctgggtttcagagctatgctggaaacagc

SEQ ID NO: 56106 - DNA, 70 bp, Artificial Sequence
  Synthetic
gccaagcatttaggtgacactatagctctgacctcactcctaggggtttcagagctatgctggaaacagc

SEQ ID NO: 56107 - DNA, 70 bp, Artificial Sequence
  Synthetic
gccaagcatttaggtgacactataggagttggggagggtcagggcgtttcagagctatgctggaaacagc

SEQ ID NO: 56108 - DNA, 70 bp, Artificial Sequence
  Synthetic
gccaagcatttaggtgacactataggtgaggagacgacggtcagggtttcagagctatgctggaaacagc

SEQ ID NO: 56109 - DNA, 70 bp, Artificial Sequence
  Synthetic
gccaagcatttaggtgacactatagtgtgcgtgatgctgatatccgtttcagagctatgctggaaacagc

SEQ ID NO: 56110 - DNA, 70 bp, Artificial Sequence
  Synthetic
gccaagcatttaggtgacactatagcacagggtctggctctaagagtttcagagctatgctggaaacagc

SEQ ID NO: 56111 - DNA, 70 bp, Artificial Sequence
  Synthetic
gccaagcatttaggtgacactatagaacggaggggaagaggaggcgtttcagagctatgctggaaacagc

SEQ ID NO: 56112 - DNA, 70 bp, Artificial Sequence
  Synthetic
gccaagcatttaggtgacactatagccgcaggaggtggacgtctggtttcagagctatgctggaaacagc

SEQ ID NO: 56113 - DNA, 70 bp, Artificial Sequence
  Synthetic
gccaagcatttaggtgacactatagcaagggtctggctcatctacgtttcagagctatgctggaaacagc

SEQ ID NO: 56114 - DNA, 70 bp, Artificial Sequence
  Synthetic
gccaagcatttaggtgacactatagcgaagtatctaggaaaccaagtttcagagctatgctggaaacagc

SEQ ID NO: 56115 - DNA, 70 bp, Artificial Sequence
  Synthetic
gccaagcatttaggtgacactatagagaccccgtgccctttaaacgtttcagagctatgctggaaacagc

SEQ ID NO: 56116 - DNA, 70 bp, Artificial Sequence
  Synthetic
gccaagcatttaggtgacactatagtgacctccacgtgaagagcagtttcagagctatgctggaaacagc

SEQ ID NO: 56117 - DNA, 70 bp, Artificial Sequence
  Synthetic
gccaagcatttaggtgacactatagtttttatttgcagtcgtcacgtttcagagctatgctggaaacagc

SEQ ID NO: 56118 - DNA, 70 bp, Artificial Sequence
  Synthetic
gccaagcatttaggtgacactatagggaaagcaaggccaaagacagtttcagagctatgctggaaacagc

SEQ ID NO: 56119 - DNA, 70 bp, Artificial Sequence
  Synthetic
gccaagcatttaggtgacactatagaggagaagctggctttacttgtttcagagctatgctggaaacagc

SEQ ID NO: 56120 - DNA, 70 bp, Artificial Sequence
  Synthetic
gccaagcatttaggtgacactataggacgtgatggttgtcactcagtttcagagctatgctggaaacagc

SEQ ID NO: 56121 - DNA, 70 bp, Artificial Sequence
  Synthetic
gccaagcatttaggtgacactataggatgatgactccaacttcaggtttcagagctatgctggaaacagc

SEQ ID NO: 56122 - DNA, 70 bp, Artificial Sequence
  Synthetic
gccaagcatttaggtgacactatagcgtgggtgtgggagattagcgtttcagagctatgctggaaacagc

SEQ ID NO: 56123 - DNA, 70 bp, Artificial Sequence
  Synthetic
gccaagcatttaggtgacactataggtggcagtgcgaggtggagggtttcagagctatgctggaaacagc

SEQ ID NO: 56124 - DNA, 70 bp, Artificial Sequence
  Synthetic
gccaagcatttaggtgacactatagcatgccattcgagggggagggtttcagagctatgctggaaacagc

SEQ ID NO: 56125 - DNA, 70 bp, Artificial Sequence
  Synthetic
gccaagcatttaggtgacactatagcttctgcagaatgctctgtcgtttcagagctatgctggaaacagc

SEQ ID NO: 56126 - DNA, 70 bp, Artificial Sequence
  Synthetic
gccaagcatttaggtgacactataggaaggggctgagtgatgtttgtttcagagctatgctggaaacagc

SEQ ID NO: 56127 - DNA, 70 bp, Artificial Sequence
  Synthetic
gccaagcatttaggtgacactatagttcccaaggtcttcaggatggtttcagagctatgctggaaacagc

SEQ ID NO: 56128 - DNA, 70 bp, Artificial Sequence
  Synthetic
gccaagcatttaggtgacactatagggtctgccccgagggcttacgtttcagagctatgctggaaacagc

SEQ ID NO: 56129 - DNA, 70 bp, Artificial Sequence
  Synthetic
gccaagcatttaggtgacactatagtctattttctatgtgcctgcgtttcagagctatgctggaaacagc

SEQ ID NO: 56130 - DNA, 70 bp, Artificial Sequence
  Synthetic
gccaagcatttaggtgacactataggaaccttactactatggctagtttcagagctatgctggaaacagc

SEQ ID NO: 56131 - DNA, 70 bp, Artificial Sequence
  Synthetic
gccaagcatttaggtgacactataggatccgtcttcacttcctgtgtttcagagctatgctggaaacagc

SEQ ID NO: 56132 - DNA, 70 bp, Artificial Sequence
  Synthetic
gccaagcatttaggtgacactatagcaggtctctgctggcagagggtttcagagctatgctggaaacagc

SEQ ID NO: 56133 - DNA, 70 bp, Artificial Sequence
  Synthetic
gccaagcatttaggtgacactatagccggaggaagctgcagccctgtttcagagctatgctggaaacagc

SEQ ID NO: 56134 - DNA, 70 bp, Artificial Sequence
  Synthetic
gccaagcatttaggtgacactatagcgcggccactgcctgtgtgagtttcagagctatgctggaaacagc

SEQ ID NO: 56135 - DNA, 70 bp, Artificial Sequence
  Synthetic
gccaagcatttaggtgacactatagttaaaaggacgcagagttgagtttcagagctatgctggaaacagc

SEQ ID NO: 56136 - DNA, 70 bp, Artificial Sequence
  Synthetic
gccaagcatttaggtgacactatagttggatcagggctcagcattgtttcagagctatgctggaaacagc

SEQ ID NO: 56137 - DNA, 70 bp, Artificial Sequence
  Synthetic
gccaagcatttaggtgacactatagtaccagcagctggaatctgagtttcagagctatgctggaaacagc

SEQ ID NO: 56138 - DNA, 70 bp, Artificial Sequence
  Synthetic
gccaagcatttaggtgacactatagccttctttctccttcatcgcgtttcagagctatgctggaaacagc

SEQ ID NO: 56139 - DNA, 70 bp, Artificial Sequence
  Synthetic
gccaagcatttaggtgacactatagggccttgaggggatcttctagtttcagagctatgctggaaacagc

SEQ ID NO: 56140 - DNA, 70 bp, Artificial Sequence
  Synthetic
gccaagcatttaggtgacactatagggaggtgtcatacgcataatgtttcagagctatgctggaaacagc

SEQ ID NO: 56141 - DNA, 70 bp, Artificial Sequence
  Synthetic
gccaagcatttaggtgacactataggacacctacatgttctgattgtttcagagctatgctggaaacagc

SEQ ID NO: 56142 - DNA, 70 bp, Artificial Sequence
  Synthetic
gccaagcatttaggtgacactatagggtcttgagggggttttctagtttcagagctatgctggaaacagc

SEQ ID NO: 56143 - DNA, 70 bp, Artificial Sequence
  Synthetic
gccaagcatttaggtgacactatagacagataccagcgtgtaacagtttcagagctatgctggaaacagc

SEQ ID NO: 56144 - DNA, 70 bp, Artificial Sequence
  Synthetic
gccaagcatttaggtgacactatagtaatggaccaagagcctgcagtttcagagctatgctggaaacagc

SEQ ID NO: 56145 - DNA, 70 bp, Artificial Sequence
  Synthetic
gccaagcatttaggtgacactataggcatgcagactcacgtgtaggtttcagagctatgctggaaacagc

SEQ ID NO: 56146 - DNA, 70 bp, Artificial Sequence
  Synthetic
gccaagcatttaggtgacactatagaaagatgtcacacgtgagtcgtttcagagctatgctggaaacagc

SEQ ID NO: 56147 - DNA, 70 bp, Artificial Sequence
  Synthetic
gccaagcatttaggtgacactatagggatctccaacttgccataagtttcagagctatgctggaaacagc

SEQ ID NO: 56148 - DNA, 70 bp, Artificial Sequence
  Synthetic
gccaagcatttaggtgacactatagagcaggagtgcaatgaacaggtttcagagctatgctggaaacagc

SEQ ID NO: 56149 - DNA, 70 bp, Artificial Sequence
  Synthetic
gccaagcatttaggtgacactatagcggatgcagactcacgtctagtttcagagctatgctggaaacagc

SEQ ID NO: 56150 - DNA, 70 bp, Artificial Sequence
  Synthetic
gccaagcatttaggtgacactataggaagcgctgggcggggctgagtttcagagctatgctggaaacagc

SEQ ID NO: 56151 - DNA, 70 bp, Artificial Sequence
  Synthetic
gccaagcatttaggtgacactatagggacaacgcccctctctgaggtttcagagctatgctggaaacagc

SEQ ID NO: 56152 - DNA, 70 bp, Artificial Sequence
  Synthetic
gccaagcatttaggtgacactatagacatcgtcgtgcacaagcaggtttcagagctatgctggaaacagc

SEQ ID NO: 56153 - DNA, 70 bp, Artificial Sequence
  Synthetic
gccaagcatttaggtgacactataggagacagccaagtcttacaagtttcagagctatgctggaaacagc

SEQ ID NO: 56154 - DNA, 70 bp, Artificial Sequence
  Synthetic
gccaagcatttaggtgacactatagcatcagaatcatcggtgttagtttcagagctatgctggaaacagc

SEQ ID NO: 56155 - DNA, 70 bp, Artificial Sequence
  Synthetic
gccaagcatttaggtgacactatagtcacacccgaaagtctttacgtttcagagctatgctggaaacagc

SEQ ID NO: 56156 - DNA, 70 bp, Artificial Sequence
  Synthetic
gccaagcatttaggtgacactatagactctcttgcctttctttaagtttcagagctatgctggaaacagc

SEQ ID NO: 56157 - DNA, 70 bp, Artificial Sequence
  Synthetic
gccaagcatttaggtgacactatagcgacagcagcagcagtggccgtttcagagctatgctggaaacagc

SEQ ID NO: 56158 - DNA, 70 bp, Artificial Sequence
  Synthetic
gccaagcatttaggtgacactataggaggaaaatgaagctcgggcgtttcagagctatgctggaaacagc

SEQ ID NO: 56159 - DNA, 70 bp, Artificial Sequence
  Synthetic
gccaagcatttaggtgacactatagcccttcagcattagcccaccgtttcagagctatgctggaaacagc

SEQ ID NO: 56160 - DNA, 70 bp, Artificial Sequence
  Synthetic
gccaagcatttaggtgacactatagcgcagttcactggacgttaggtttcagagctatgctggaaacagc

SEQ ID NO: 56161 - DNA, 70 bp, Artificial Sequence
  Synthetic
gccaagcatttaggtgacactatagaatgtcagctgcttgaagaggtttcagagctatgctggaaacagc

SEQ ID NO: 56162 - DNA, 70 bp, Artificial Sequence
  Synthetic
gccaagcatttaggtgacactataggcagatggatgagctaagaggtttcagagctatgctggaaacagc

SEQ ID NO: 56163 - DNA, 70 bp, Artificial Sequence
  Synthetic
gccaagcatttaggtgacactatagagtgccagggcagggctcaagtttcagagctatgctggaaacagc

SEQ ID NO: 56164 - DNA, 70 bp, Artificial Sequence
  Synthetic
gccaagcatttaggtgacactatagctttccggtctgtcactgtggtttcagagctatgctggaaacagc

SEQ ID NO: 56165 - DNA, 70 bp, Artificial Sequence
  Synthetic
gccaagcatttaggtgacactatagcatgccagcctctgcctgaagtttcagagctatgctggaaacagc

SEQ ID NO: 56166 - DNA, 70 bp, Artificial Sequence
  Synthetic
gccaagcatttaggtgacactatagcggaggcatatgttggtgtggtttcagagctatgctggaaacagc

SEQ ID NO: 56167 - DNA, 70 bp, Artificial Sequence
  Synthetic
gccaagcatttaggtgacactatagctgagaagcccaggggctttgtttcagagctatgctggaaacagc

SEQ ID NO: 56168 - DNA, 70 bp, Artificial Sequence
  Synthetic
gccaagcatttaggtgacactataggtggcgggctcagggcgagcgtttcagagctatgctggaaacagc

SEQ ID NO: 56169 - DNA, 70 bp, Artificial Sequence
  Synthetic
gccaagcatttaggtgacactataggacagcaatgactgtcctacgtttcagagctatgctggaaacagc

SEQ ID NO: 56170 - DNA, 70 bp, Artificial Sequence
  Synthetic
gccaagcatttaggtgacactatagttcagggcgctttcagttcagtttcagagctatgctggaaacagc

SEQ ID NO: 56171 - DNA, 70 bp, Artificial Sequence
  Synthetic
gccaagcatttaggtgacactataggggctgcacgagggccctacgtttcagagctatgctggaaacagc

SEQ ID NO: 56172 - DNA, 70 bp, Artificial Sequence
  Synthetic
gccaagcatttaggtgacactatagtcctcctgctgctggtccttgtttcagagctatgctggaaacagc

SEQ ID NO: 56173 - DNA, 70 bp, Artificial Sequence
  Synthetic
gccaagcatttaggtgacactatagatgaaacggcacatgtagccgtttcagagctatgctggaaacagc

SEQ ID NO: 56174 - DNA, 70 bp, Artificial Sequence
  Synthetic
gccaagcatttaggtgacactataggaggcaatcagactagcatggtttcagagctatgctggaaacagc

SEQ ID NO: 56175 - DNA, 70 bp, Artificial Sequence
  Synthetic
gccaagcatttaggtgacactatagacctcgccttacacatgaaggtttcagagctatgctggaaacagc

SEQ ID NO: 56176 - DNA, 70 bp, Artificial Sequence
  Synthetic
gccaagcatttaggtgacactatagacacgggcagtgctcagttcgtttcagagctatgctggaaacagc

SEQ ID NO: 56177 - DNA, 70 bp, Artificial Sequence
  Synthetic
gccaagcatttaggtgacactatagccacctctctgctccctcaggtttcagagctatgctggaaacagc

SEQ ID NO: 56178 - DNA, 70 bp, Artificial Sequence
  Synthetic
gccaagcatttaggtgacactatagacctggccctgcacatgaaggtttcagagctatgctggaaacagc

SEQ ID NO: 56179 - DNA, 70 bp, Artificial Sequence
  Synthetic
gccaagcatttaggtgacactatagagatatgtctcttcatgtgggtttcagagctatgctggaaacagc

SEQ ID NO: 56180 - DNA, 70 bp, Artificial Sequence
  Synthetic
gccaagcatttaggtgacactatagccatcccaggtgcatttatagtttcagagctatgctggaaacagc

SEQ ID NO: 56181 - DNA, 70 bp, Artificial Sequence
  Synthetic
gccaagcatttaggtgacactatagtgtgacctgtgcggctcacagtttcagagctatgctggaaacagc

SEQ ID NO: 56182 - DNA, 70 bp, Artificial Sequence
  Synthetic
gccaagcatttaggtgacactataggcgctggccaacgctttgtggtttcagagctatgctggaaacagc

SEQ ID NO: 56183 - DNA, 70 bp, Artificial Sequence
  Synthetic
gccaagcatttaggtgacactatagtttggactctttgttcttctgtttcagagctatgctggaaacagc

SEQ ID NO: 56184 - DNA, 70 bp, Artificial Sequence
  Synthetic
gccaagcatttaggtgacactatagctcatcgaacgcttgaaatggtttcagagctatgctggaaacagc

SEQ ID NO: 56185 - DNA, 70 bp, Artificial Sequence
  Synthetic
gccaagcatttaggtgacactatagaacaacacttctggatcttagtttcagagctatgctggaaacagc

SEQ ID NO: 56186 - DNA, 70 bp, Artificial Sequence
  Synthetic
gccaagcatttaggtgacactatagcgtctcctcccatgggtagggtttcagagctatgctggaaacagc

SEQ ID NO: 56187 - DNA, 70 bp, Artificial Sequence
  Synthetic
gccaagcatttaggtgacactatagcggagaggagagcggtgcgggtttcagagctatgctggaaacagc

SEQ ID NO: 56188 - DNA, 70 bp, Artificial Sequence
  Synthetic
gccaagcatttaggtgacactataggttgagggactgctagacccgtttcagagctatgctggaaacagc

SEQ ID NO: 56189 - DNA, 70 bp, Artificial Sequence
  Synthetic
gccaagcatttaggtgacactataggctgcagacctcactctgaggtttcagagctatgctggaaacagc

SEQ ID NO: 56190 - DNA, 70 bp, Artificial Sequence
  Synthetic
gccaagcatttaggtgacactataggctaggagtcagagacacacgtttcagagctatgctggaaacagc

SEQ ID NO: 56191 - DNA, 70 bp, Artificial Sequence
  Synthetic
gccaagcatttaggtgacactataggtctgcgtgatggggtctgagtttcagagctatgctggaaacagc

SEQ ID NO: 56192 - DNA, 70 bp, Artificial Sequence
  Synthetic
gccaagcatttaggtgacactatagcagtccacaggtttgcatccgtttcagagctatgctggaaacagc

SEQ ID NO: 56193 - DNA, 70 bp, Artificial Sequence
  Synthetic
gccaagcatttaggtgacactataggcagatggtgtctctagctcgtttcagagctatgctggaaacagc

SEQ ID NO: 56194 - DNA, 70 bp, Artificial Sequence
  Synthetic
gccaagcatttaggtgacactatagttgcttgatgactaccacacgtttcagagctatgctggaaacagc

SEQ ID NO: 56195 - DNA, 70 bp, Artificial Sequence
  Synthetic
gccaagcatttaggtgacactatagctaaatgaagaggctcatacgtttcagagctatgctggaaacagc

SEQ ID NO: 56196 - DNA, 70 bp, Artificial Sequence
  Synthetic
gccaagcatttaggtgacactatagaagctctcagattgaatgctgtttcagagctatgctggaaacagc

SEQ ID NO: 56197 - DNA, 70 bp, Artificial Sequence
  Synthetic
gccaagcatttaggtgacactatagccaacaatggtcacttctcggtttcagagctatgctggaaacagc

SEQ ID NO: 56198 - DNA, 70 bp, Artificial Sequence
  Synthetic
gccaagcatttaggtgacactatagtgatcttaaggtgcagaaaggtttcagagctatgctggaaacagc

SEQ ID NO: 56199 - DNA, 70 bp, Artificial Sequence
  Synthetic
gccaagcatttaggtgacactatagtcctggtgttatttgttgtagtttcagagctatgctggaaacagc

SEQ ID NO: 56200 - DNA, 70 bp, Artificial Sequence
  Synthetic
gccaagcatttaggtgacactatagactatgtactggatgaggtcgtttcagagctatgctggaaacagc

SEQ ID NO: 56201 - DNA, 70 bp, Artificial Sequence
  Synthetic
gccaagcatttaggtgacactatagtctggtggtaggtgggtcaggtttcagagctatgctggaaacagc

SEQ ID NO: 56202 - DNA, 70 bp, Artificial Sequence
  Synthetic
gccaagcatttaggtgacactatagatcccatcctctgccttagagtttcagagctatgctggaaacagc

SEQ ID NO: 56203 - DNA, 70 bp, Artificial Sequence
  Synthetic
gccaagcatttaggtgacactatagaatgtccttcaggctcataagtttcagagctatgctggaaacagc

SEQ ID NO: 56204 - DNA, 70 bp, Artificial Sequence
  Synthetic
gccaagcatttaggtgacactatagttctctgtgttcaccaaatagtttcagagctatgctggaaacagc

SEQ ID NO: 56205 - DNA, 70 bp, Artificial Sequence
  Synthetic
gccaagcatttaggtgacactatagcaacccgacgaggaacgaatgtttcagagctatgctggaaacagc

SEQ ID NO: 56206 - DNA, 70 bp, Artificial Sequence
  Synthetic
gccaagcatttaggtgacactatagctggggctagtgcagctcatgtttcagagctatgctggaaacagc

SEQ ID NO: 56207 - DNA, 70 bp, Artificial Sequence
  Synthetic
gccaagcatttaggtgacactatagtgacaactccagtgaggactgtttcagagctatgctggaaacagc

SEQ ID NO: 56208 - DNA, 70 bp, Artificial Sequence
  Synthetic
gccaagcatttaggtgacactatagccagtgccatgcggtctcatgtttcagagctatgctggaaacagc

SEQ ID NO: 56209 - DNA, 70 bp, Artificial Sequence
  Synthetic
gccaagcatttaggtgacactatagaatagtcacacagccatgatgtttcagagctatgctggaaacagc

SEQ ID NO: 56210 - DNA, 70 bp, Artificial Sequence
  Synthetic
gccaagcatttaggtgacactatagctcagcaggtgctcctcacggtttcagagctatgctggaaacagc

SEQ ID NO: 56211 - DNA, 70 bp, Artificial Sequence
  Synthetic
gccaagcatttaggtgacactatagagacaacatgcggtcaggccgtttcagagctatgctggaaacagc

SEQ ID NO: 56212 - DNA, 70 bp, Artificial Sequence
  Synthetic
gccaagcatttaggtgacactatagaggctggagtgcagtgccaggtttcagagctatgctggaaacagc

SEQ ID NO: 56213 - DNA, 70 bp, Artificial Sequence
  Synthetic
gccaagcatttaggtgacactataggggtcttgggggctacctccgtttcagagctatgctggaaacagc

SEQ ID NO: 56214 - DNA, 70 bp, Artificial Sequence
  Synthetic
gccaagcatttaggtgacactatagtatactgtcgctgcaactttgtttcagagctatgctggaaacagc

SEQ ID NO: 56215 - DNA, 70 bp, Artificial Sequence
  Synthetic
gccaagcatttaggtgacactatagccctgccctgtgttcagacagtttcagagctatgctggaaacagc

SEQ ID NO: 56216 - DNA, 70 bp, Artificial Sequence
  Synthetic
gccaagcatttaggtgacactatagcagtaggagtttgggtcacagtttcagagctatgctggaaacagc

SEQ ID NO: 56217 - DNA, 70 bp, Artificial Sequence
  Synthetic
gccaagcatttaggtgacactatagtggccctggtttagtgctccgtttcagagctatgctggaaacagc

SEQ ID NO: 56218 - DNA, 70 bp, Artificial Sequence
  Synthetic
gccaagcatttaggtgacactatagacctgggctcagatactgacgtttcagagctatgctggaaacagc

SEQ ID NO: 56219 - DNA, 70 bp, Artificial Sequence
  Synthetic
gccaagcatttaggtgacactatagaggtagaacatacctcatgtgtttcagagctatgctggaaacagc

SEQ ID NO: 56220 - DNA, 70 bp, Artificial Sequence
  Synthetic
gccaagcatttaggtgacactatagctgttgcagtctcacttgctgtttcagagctatgctggaaacagc

SEQ ID NO: 56221 - DNA, 70 bp, Artificial Sequence
  Synthetic
gccaagcatttaggtgacactatagtgatggcttggcttttcagagtttcagagctatgctggaaacagc

SEQ ID NO: 56222 - DNA, 70 bp, Artificial Sequence
  Synthetic
gccaagcatttaggtgacactatagaccaaacctgctgggtgaaggtttcagagctatgctggaaacagc

SEQ ID NO: 56223 - DNA, 70 bp, Artificial Sequence
  Synthetic
gccaagcatttaggtgacactataggatttggtgctgggctgaatgtttcagagctatgctggaaacagc

SEQ ID NO: 56224 - DNA, 70 bp, Artificial Sequence
  Synthetic
gccaagcatttaggtgacactatagccatcatccagagcttgggcgtttcagagctatgctggaaacagc

SEQ ID NO: 56225 - DNA, 70 bp, Artificial Sequence
  Synthetic
gccaagcatttaggtgacactatagagaggcgcagctagggtcacgtttcagagctatgctggaaacagc

SEQ ID NO: 56226 - DNA, 70 bp, Artificial Sequence
  Synthetic
gccaagcatttaggtgacactatagaggtttcttgtcgacctcatgtttcagagctatgctggaaacagc

SEQ ID NO: 56227 - DNA, 70 bp, Artificial Sequence
  Synthetic
gccaagcatttaggtgacactatagagaagctgaaagagactctggtttcagagctatgctggaaacagc

SEQ ID NO: 56228 - DNA, 70 bp, Artificial Sequence
  Synthetic
gccaagcatttaggtgacactatagagctggtgcatgtgttgtaggtttcagagctatgctggaaacagc

SEQ ID NO: 56229 - DNA, 70 bp, Artificial Sequence
  Synthetic
gccaagcatttaggtgacactataggagctggtcacatcttagtcgtttcagagctatgctggaaacagc

SEQ ID NO: 56230 - DNA, 70 bp, Artificial Sequence
  Synthetic
gccaagcatttaggtgacactatagagagatttaaacgtgttgctgtttcagagctatgctggaaacagc

SEQ ID NO: 56231 - DNA, 70 bp, Artificial Sequence
  Synthetic
gccaagcatttaggtgacactatagagcttttggacataacttgcgtttcagagctatgctggaaacagc

SEQ ID NO: 56232 - DNA, 70 bp, Artificial Sequence
  Synthetic
gccaagcatttaggtgacactatagccactgtgcctaggaagagcgtttcagagctatgctggaaacagc

SEQ ID NO: 56233 - DNA, 70 bp, Artificial Sequence
  Synthetic
gccaagcatttaggtgacactatagccggagcagtgtctgtctgagtttcagagctatgctggaaacagc

SEQ ID NO: 56234 - DNA, 70 bp, Artificial Sequence
  Synthetic
gccaagcatttaggtgacactataggtgaaaagcataccacactcgtttcagagctatgctggaaacagc

SEQ ID NO: 56235 - DNA, 70 bp, Artificial Sequence
  Synthetic
gccaagcatttaggtgacactatagatttgtgttgtcgatacttggtttcagagctatgctggaaacagc

SEQ ID NO: 56236 - DNA, 70 bp, Artificial Sequence
  Synthetic
gccaagcatttaggtgacactatagaggtcatggatccaataatggtttcagagctatgctggaaacagc

SEQ ID NO: 56237 - DNA, 70 bp, Artificial Sequence
  Synthetic
gccaagcatttaggtgacactatagagcaccttcagatcattcttgtttcagagctatgctggaaacagc

SEQ ID NO: 56238 - DNA, 70 bp, Artificial Sequence
  Synthetic
gccaagcatttaggtgacactatagcgttcaggagttctccgctagtttcagagctatgctggaaacagc

SEQ ID NO: 56239 - DNA, 70 bp, Artificial Sequence
  Synthetic
gccaagcatttaggtgacactatagagcgtagcatctggatcagtgtttcagagctatgctggaaacagc

SEQ ID NO: 56240 - DNA, 70 bp, Artificial Sequence
  Synthetic
gccaagcatttaggtgacactatagacgatgaagaacaattagacgtttcagagctatgctggaaacagc

SEQ ID NO: 56241 - DNA, 70 bp, Artificial Sequence
  Synthetic
gccaagcatttaggtgacactatagactggatccggatgatcatggtttcagagctatgctggaaacagc

SEQ ID NO: 56242 - DNA, 70 bp, Artificial Sequence
  Synthetic
gccaagcatttaggtgacactatagccccgctcgtgggtcttagagtttcagagctatgctggaaacagc

SEQ ID NO: 56243 - DNA, 70 bp, Artificial Sequence
  Synthetic
gccaagcatttaggtgacactatagagagttagaggatgttgtcagtttcagagctatgctggaaacagc

SEQ ID NO: 56244 - DNA, 70 bp, Artificial Sequence
  Synthetic
gccaagcatttaggtgacactatagcagcagcaaaaatggttgaagtttcagagctatgctggaaacagc

SEQ ID NO: 56245 - DNA, 70 bp, Artificial Sequence
  Synthetic
gccaagcatttaggtgacactatagaaacgatgcgggacaaatgagtttcagagctatgctggaaacagc

SEQ ID NO: 56246 - DNA, 70 bp, Artificial Sequence
  Synthetic
gccaagcatttaggtgacactataggaatagtcagttcctcttcagtttcagagctatgctggaaacagc

SEQ ID NO: 56247 - DNA, 70 bp, Artificial Sequence
  Synthetic
gccaagcatttaggtgacactataggctgggagcccccggtcacagtttcagagctatgctggaaacagc

SEQ ID NO: 56248 - DNA, 70 bp, Artificial Sequence
  Synthetic
gccaagcatttaggtgacactatagggtgggacaggggcactcaggtttcagagctatgctggaaacagc

SEQ ID NO: 56249 - DNA, 70 bp, Artificial Sequence
  Synthetic
gccaagcatttaggtgacactatagtcccaacatctggaggggaagtttcagagctatgctggaaacagc

SEQ ID NO: 56250 - DNA, 70 bp, Artificial Sequence
  Synthetic
gccaagcatttaggtgacactataggggttgataggggtgctcaggtttcagagctatgctggaaacagc

SEQ ID NO: 56251 - DNA, 70 bp, Artificial Sequence
  Synthetic
gccaagcatttaggtgacactatagtccctagtgccctggagagggtttcagagctatgctggaaacagc

SEQ ID NO: 56252 - DNA, 70 bp, Artificial Sequence
  Synthetic
gccaagcatttaggtgacactatagggttgggtcaacgtgccacagtttcagagctatgctggaaacagc

SEQ ID NO: 56253 - DNA, 70 bp, Artificial Sequence
  Synthetic
gccaagcatttaggtgacactatagtcccagtccccagagttaacgtttcagagctatgctggaaacagc

SEQ ID NO: 56254 - DNA, 70 bp, Artificial Sequence
  Synthetic
gccaagcatttaggtgacactatagtcctgggatgactcaggagtgtttcagagctatgctggaaacagc

SEQ ID NO: 56255 - DNA, 70 bp, Artificial Sequence
  Synthetic
gccaagcatttaggtgacactatagggaggtagatgtcacatgtcgtttcagagctatgctggaaacagc

SEQ ID NO: 56256 - DNA, 70 bp, Artificial Sequence
  Synthetic
gccaagcatttaggtgacactatagtgtcacatgtcagggtcactgtttcagagctatgctggaaacagc

SEQ ID NO: 56257 - DNA, 70 bp, Artificial Sequence
  Synthetic
gccaagcatttaggtgacactataggcgttagcgatgctttttcagtttcagagctatgctggaaacagc

SEQ ID NO: 56258 - DNA, 70 bp, Artificial Sequence
  Synthetic
gccaagcatttaggtgacactataggactggatcaagaagatcatgtttcagagctatgctggaaacagc

SEQ ID NO: 56259 - DNA, 70 bp, Artificial Sequence
  Synthetic
gccaagcatttaggtgacactatagaagaagatcataggcagcaagtttcagagctatgctggaaacagc

SEQ ID NO: 56260 - DNA, 70 bp, Artificial Sequence
  Synthetic
gccaagcatttaggtgacactatagtgactggatccaagaaatcagtttcagagctatgctggaaacagc

SEQ ID NO: 56261 - DNA, 70 bp, Artificial Sequence
  Synthetic
gccaagcatttaggtgacactatagctctggactgcttctcatgcgtttcagagctatgctggaaacagc

SEQ ID NO: 56262 - DNA, 70 bp, Artificial Sequence
  Synthetic
gccaagcatttaggtgacactatagggcatcaccagctggggtgagtttcagagctatgctggaaacagc

SEQ ID NO: 56263 - DNA, 70 bp, Artificial Sequence
  Synthetic
gccaagcatttaggtgacactatagagtctcaggtctcagtccttgtttcagagctatgctggaaacagc

SEQ ID NO: 56264 - DNA, 70 bp, Artificial Sequence
  Synthetic
gccaagcatttaggtgacactatagtcacaggtgttagttcttttgtttcagagctatgctggaaacagc

SEQ ID NO: 56265 - DNA, 70 bp, Artificial Sequence
  Synthetic
gccaagcatttaggtgacactatagcgacttaaatcagcccagtggtttcagagctatgctggaaacagc

SEQ ID NO: 56266 - DNA, 70 bp, Artificial Sequence
  Synthetic
gccaagcatttaggtgacactatagatatcattgaagatccacacgtttcagagctatgctggaaacagc

SEQ ID NO: 56267 - DNA, 70 bp, Artificial Sequence
  Synthetic
gccaagcatttaggtgacactatagtgattcttgaagatccacacgtttcagagctatgctggaaacagc

SEQ ID NO: 56268 - DNA, 70 bp, Artificial Sequence
  Synthetic
gccaagcatttaggtgacactatagatcagagttcttcgaagcacgtttcagagctatgctggaaacagc

SEQ ID NO: 56269 - DNA, 70 bp, Artificial Sequence
  Synthetic
gccaagcatttaggtgacactatagtgcatagcgtataatccaaagtttcagagctatgctggaaacagc

SEQ ID NO: 56270 - DNA, 70 bp, Artificial Sequence
  Synthetic
gccaagcatttaggtgacactatagcctgcagcagtgttttcaaagtttcagagctatgctggaaacagc

SEQ ID NO: 56271 - DNA, 70 bp, Artificial Sequence
  Synthetic
gccaagcatttaggtgacactatagtttgatctccttgatcctgtgtttcagagctatgctggaaacagc

SEQ ID NO: 56272 - DNA, 70 bp, Artificial Sequence
  Synthetic
gccaagcatttaggtgacactatagttgacgcacaatggaaccaggtttcagagctatgctggaaacagc

SEQ ID NO: 56273 - DNA, 70 bp, Artificial Sequence
  Synthetic
gccaagcatttaggtgacactatagctgtgaagttcctttacactgtttcagagctatgctggaaacagc

SEQ ID NO: 56274 - DNA, 70 bp, Artificial Sequence
  Synthetic
gccaagcatttaggtgacactatagtttacactgggtgtgtaagagtttcagagctatgctggaaacagc

SEQ ID NO: 56275 - DNA, 70 bp, Artificial Sequence
  Synthetic
gccaagcatttaggtgacactataggccaaggggacccagtgatcgtttcagagctatgctggaaacagc

SEQ ID NO: 56276 - DNA, 70 bp, Artificial Sequence
  Synthetic
gccaagcatttaggtgacactatagatacgtacatctgcatgcaagtttcagagctatgctggaaacagc

SEQ ID NO: 56277 - DNA, 70 bp, Artificial Sequence
  Synthetic
gccaagcatttaggtgacactatagctatcacctgctaatgagatgtttcagagctatgctggaaacagc

SEQ ID NO: 56278 - DNA, 70 bp, Artificial Sequence
  Synthetic
gccaagcatttaggtgacactataggagaagagcagctttagtttgtttcagagctatgctggaaacagc

SEQ ID NO: 56279 - DNA, 70 bp, Artificial Sequence
  Synthetic
gccaagcatttaggtgacactatagtgccgtcggttccttaactggtttcagagctatgctggaaacagc

SEQ ID NO: 56280 - DNA, 70 bp, Artificial Sequence
  Synthetic
gccaagcatttaggtgacactatagcatttcagttcatccacttcgtttcagagctatgctggaaacagc

SEQ ID NO: 56281 - DNA, 70 bp, Artificial Sequence
  Synthetic
gccaagcatttaggtgacactataggagcctggaattgtcggaaagtttcagagctatgctggaaacagc

SEQ ID NO: 56282 - DNA, 70 bp, Artificial Sequence
  Synthetic
gccaagcatttaggtgacactataggggtcagggtggcattaaaagtttcagagctatgctggaaacagc

SEQ ID NO: 56283 - DNA, 70 bp, Artificial Sequence
  Synthetic
gccaagcatttaggtgacactatagcccgtggctgaagcattaacgtttcagagctatgctggaaacagc

SEQ ID NO: 56284 - DNA, 70 bp, Artificial Sequence
  Synthetic
gccaagcatttaggtgacactatagaagcgcttgaggttaatagtgtttcagagctatgctggaaacagc

SEQ ID NO: 56285 - DNA, 70 bp, Artificial Sequence
  Synthetic
gccaagcatttaggtgacactatagtgcattgtttttttcctgaggtttcagagctatgctggaaacagc

SEQ ID NO: 56286 - DNA, 70 bp, Artificial Sequence
  Synthetic
gccaagcatttaggtgacactatagcggcggtgaagagctgtgacgtttcagagctatgctggaaacagc

SEQ ID NO: 56287 - DNA, 70 bp, Artificial Sequence
  Synthetic
gccaagcatttaggtgacactatagctgtggttcacttctgtagcgtttcagagctatgctggaaacagc

SEQ ID NO: 56288 - DNA, 70 bp, Artificial Sequence
  Synthetic
gccaagcatttaggtgacactatagccaggcccgagctcggctacgtttcagagctatgctggaaacagc

SEQ ID NO: 56289 - DNA, 70 bp, Artificial Sequence
  Synthetic
gccaagcatttaggtgacactatagcctcaccttggttcgtgagcgtttcagagctatgctggaaacagc

SEQ ID NO: 56290 - DNA, 70 bp, Artificial Sequence
  Synthetic
gccaagcatttaggtgacactataggggcccagacagggcctcacgtttcagagctatgctggaaacagc

SEQ ID NO: 56291 - DNA, 70 bp, Artificial Sequence
  Synthetic
gccaagcatttaggtgacactatagtgctttactttctctgcccagtttcagagctatgctggaaacagc

SEQ ID NO: 56292 - DNA, 70 bp, Artificial Sequence
  Synthetic
gccaagcatttaggtgacactatagaatttcactaactgacttccgtttcagagctatgctggaaacagc

SEQ ID NO: 56293 - DNA, 70 bp, Artificial Sequence
  Synthetic
gccaagcatttaggtgacactatagagagccagcatctgagaggggtttcagagctatgctggaaacagc

SEQ ID NO: 56294 - DNA, 70 bp, Artificial Sequence
  Synthetic
gccaagcatttaggtgacactatagatggtggtccaagggtctaggtttcagagctatgctggaaacagc

SEQ ID NO: 56295 - DNA, 70 bp, Artificial Sequence
  Synthetic
gccaagcatttaggtgacactatagcgcttccaagtcagtcaagcgtttcagagctatgctggaaacagc

SEQ ID NO: 56296 - DNA, 70 bp, Artificial Sequence
  Synthetic
gccaagcatttaggtgacactatagaacaacagcccttaaggaaagtttcagagctatgctggaaacagc

SEQ ID NO: 56297 - DNA, 70 bp, Artificial Sequence
  Synthetic
gccaagcatttaggtgacactataggctgttagaaactttgcaaggtttcagagctatgctggaaacagc

SEQ ID NO: 56298 - DNA, 70 bp, Artificial Sequence
  Synthetic
gccaagcatttaggtgacactatagggatattgcaccaaatgtaggtttcagagctatgctggaaacagc

SEQ ID NO: 56299 - DNA, 70 bp, Artificial Sequence
  Synthetic
gccaagcatttaggtgacactatagatttcacagggagcagtgtcgtttcagagctatgctggaaacagc

SEQ ID NO: 56300 - DNA, 70 bp, Artificial Sequence
  Synthetic
gccaagcatttaggtgacactataggcagagtattgcttcaaagcgtttcagagctatgctggaaacagc

SEQ ID NO: 56301 - DNA, 70 bp, Artificial Sequence
  Synthetic
gccaagcatttaggtgacactatagatctaaaagttaaaggtcccgtttcagagctatgctggaaacagc

SEQ ID NO: 56302 - DNA, 70 bp, Artificial Sequence
  Synthetic
gccaagcatttaggtgacactatagtttgtttgaaggttggctgtgtttcagagctatgctggaaacagc

SEQ ID NO: 56303 - DNA, 70 bp, Artificial Sequence
  Synthetic
gccaagcatttaggtgacactatagctgccaatgtaccaacagaagtttcagagctatgctggaaacagc

SEQ ID NO: 56304 - DNA, 70 bp, Artificial Sequence
  Synthetic
gccaagcatttaggtgacactatagcagcaggaagcaccaatggagtttcagagctatgctggaaacagc

SEQ ID NO: 56305 - DNA, 70 bp, Artificial Sequence
  Synthetic
gccaagcatttaggtgacactatagctggaggcagatattatagcgtttcagagctatgctggaaacagc

SEQ ID NO: 56306 - DNA, 70 bp, Artificial Sequence
  Synthetic
gccaagcatttaggtgacactatagtgacttggctcagtaaagttgtttcagagctatgctggaaacagc

SEQ ID NO: 56307 - DNA, 70 bp, Artificial Sequence
  Synthetic
gccaagcatttaggtgacactatagcatgggcaacaaaagaactggtttcagagctatgctggaaacagc

SEQ ID NO: 56308 - DNA, 70 bp, Artificial Sequence
  Synthetic
gccaagcatttaggtgacactatagtgcctttgctggagtgaaaggtttcagagctatgctggaaacagc

SEQ ID NO: 56309 - DNA, 70 bp, Artificial Sequence
  Synthetic
gccaagcatttaggtgacactatagtgggtgcatgggtgcttaaggtttcagagctatgctggaaacagc

SEQ ID NO: 56310 - DNA, 70 bp, Artificial Sequence
  Synthetic
gccaagcatttaggtgacactatagaacatcagcaaagacaagacgtttcagagctatgctggaaacagc

SEQ ID NO: 56311 - DNA, 70 bp, Artificial Sequence
  Synthetic
gccaagcatttaggtgacactatagagcaaagaagaaaagactccgtttcagagctatgctggaaacagc

SEQ ID NO: 56312 - DNA, 70 bp, Artificial Sequence
  Synthetic
gccaagcatttaggtgacactatagcgagatggggggcgcattgagtttcagagctatgctggaaacagc

SEQ ID NO: 56313 - DNA, 70 bp, Artificial Sequence
  Synthetic
gccaagcatttaggtgacactatagagccatctgttcaccagcaggtttcagagctatgctggaaacagc

SEQ ID NO: 56314 - DNA, 70 bp, Artificial Sequence
  Synthetic
gccaagcatttaggtgacactatagatcgtcaatgctgggaagacgtttcagagctatgctggaaacagc

SEQ ID NO: 56315 - DNA, 70 bp, Artificial Sequence
  Synthetic
gccaagcatttaggtgacactatagacagcacttcaaaatacatggtttcagagctatgctggaaacagc

SEQ ID NO: 56316 - DNA, 70 bp, Artificial Sequence
  Synthetic
gccaagcatttaggtgacactataggaaacactgaaggatgaaaggtttcagagctatgctggaaacagc

SEQ ID NO: 56317 - DNA, 70 bp, Artificial Sequence
  Synthetic
gccaagcatttaggtgacactatagctttgggaccagtctattctgtttcagagctatgctggaaacagc

SEQ ID NO: 56318 - DNA, 70 bp, Artificial Sequence
  Synthetic
gccaagcatttaggtgacactatagggggtttttagtcactcacagtttcagagctatgctggaaacagc

SEQ ID NO: 56319 - DNA, 70 bp, Artificial Sequence
  Synthetic
gccaagcatttaggtgacactatagtgtctacagtcagatacttcgtttcagagctatgctggaaacagc

SEQ ID NO: 56320 - DNA, 70 bp, Artificial Sequence
  Synthetic
gccaagcatttaggtgacactatagcggggcccagagtcagagaggtttcagagctatgctggaaacagc

SEQ ID NO: 56321 - DNA, 70 bp, Artificial Sequence
  Synthetic
gccaagcatttaggtgacactatagctctggctggaggcactcaggtttcagagctatgctggaaacagc

SEQ ID NO: 56322 - DNA, 70 bp, Artificial Sequence
  Synthetic
gccaagcatttaggtgacactatagtggtgctcaggagctgttctgtttcagagctatgctggaaacagc

SEQ ID NO: 56323 - DNA, 70 bp, Artificial Sequence
  Synthetic
gccaagcatttaggtgacactatagttgttttcagatccatagcagtttcagagctatgctggaaacagc

SEQ ID NO: 56324 - DNA, 70 bp, Artificial Sequence
  Synthetic
gccaagcatttaggtgacactatagagaaattgcacttaagatgggtttcagagctatgctggaaacagc

SEQ ID NO: 56325 - DNA, 70 bp, Artificial Sequence
  Synthetic
gccaagcatttaggtgacactatagacagagggcatctctttatcgtttcagagctatgctggaaacagc

SEQ ID NO: 56326 - DNA, 70 bp, Artificial Sequence
  Synthetic
gccaagcatttaggtgacactataggtgggcgagtcttcatctaagtttcagagctatgctggaaacagc

SEQ ID NO: 56327 - DNA, 70 bp, Artificial Sequence
  Synthetic
gccaagcatttaggtgacactatagggtggtctcatctcaagttcgtttcagagctatgctggaaacagc

SEQ ID NO: 56328 - DNA, 70 bp, Artificial Sequence
  Synthetic
gccaagcatttaggtgacactatagccaggcagatttaaggcctagtttcagagctatgctggaaacagc

SEQ ID NO: 56329 - DNA, 70 bp, Artificial Sequence
  Synthetic
gccaagcatttaggtgacactatagcgtggtaacagaggtgctacgtttcagagctatgctggaaacagc

SEQ ID NO: 56330 - DNA, 70 bp, Artificial Sequence
  Synthetic
gccaagcatttaggtgacactataggtccttcgcaccaagaactggtttcagagctatgctggaaacagc

SEQ ID NO: 56331 - DNA, 70 bp, Artificial Sequence
  Synthetic
gccaagcatttaggtgacactatagacacttagatttctctcttggtttcagagctatgctggaaacagc

SEQ ID NO: 56332 - DNA, 70 bp, Artificial Sequence
  Synthetic
gccaagcatttaggtgacactatagcagctcagttctaggagctcgtttcagagctatgctggaaacagc

SEQ ID NO: 56333 - DNA, 70 bp, Artificial Sequence
  Synthetic
gccaagcatttaggtgacactatagcggggtagctgagtcctcaggtttcagagctatgctggaaacagc

SEQ ID NO: 56334 - DNA, 70 bp, Artificial Sequence
  Synthetic
gccaagcatttaggtgacactatagccaatgacaccaaagttctggtttcagagctatgctggaaacagc

SEQ ID NO: 56335 - DNA, 70 bp, Artificial Sequence
  Synthetic
gccaagcatttaggtgacactatagcccagagcctgctgcctcaggtttcagagctatgctggaaacagc

SEQ ID NO: 56336 - DNA, 70 bp, Artificial Sequence
  Synthetic
gccaagcatttaggtgacactatagtctaaaagagaaggtcacgcgtttcagagctatgctggaaacagc

SEQ ID NO: 56337 - DNA, 70 bp, Artificial Sequence
  Synthetic
gccaagcatttaggtgacactataggtcatctgaagtcaaagagggtttcagagctatgctggaaacagc

SEQ ID NO: 56338 - DNA, 70 bp, Artificial Sequence
  Synthetic
gccaagcatttaggtgacactatagtgttgatggaggtttgataggtttcagagctatgctggaaacagc

SEQ ID NO: 56339 - DNA, 70 bp, Artificial Sequence
  Synthetic
gccaagcatttaggtgacactatagattggtctcatgcgtgctttgtttcagagctatgctggaaacagc

SEQ ID NO: 56340 - DNA, 70 bp, Artificial Sequence
  Synthetic
gccaagcatttaggtgacactatagtcaagtcagcagtatttctggtttcagagctatgctggaaacagc

SEQ ID NO: 56341 - DNA, 70 bp, Artificial Sequence
  Synthetic
gccaagcatttaggtgacactatagtgctttgagatttctcttccgtttcagagctatgctggaaacagc

SEQ ID NO: 56342 - DNA, 70 bp, Artificial Sequence
  Synthetic
gccaagcatttaggtgacactatagccttctaaagcaccataatggtttcagagctatgctggaaacagc

SEQ ID NO: 56343 - DNA, 70 bp, Artificial Sequence
  Synthetic
gccaagcatttaggtgacactatagtcaacaacaagaatgaacaggtttcagagctatgctggaaacagc

SEQ ID NO: 56344 - DNA, 70 bp, Artificial Sequence
  Synthetic
gccaagcatttaggtgacactatagcaacggcaagacagaacaaagtttcagagctatgctggaaacagc

SEQ ID NO: 56345 - DNA, 70 bp, Artificial Sequence
  Synthetic
gccaagcatttaggtgacactataggctgatgcgtgctctttatcgtttcagagctatgctggaaacagc

SEQ ID NO: 56346 - DNA, 70 bp, Artificial Sequence
  Synthetic
gccaagcatttaggtgacactatagccctaggttctagcgcacgagtttcagagctatgctggaaacagc

SEQ ID NO: 56347 - DNA, 70 bp, Artificial Sequence
  Synthetic
gccaagcatttaggtgacactataggcacaaagggacttcagtaggtttcagagctatgctggaaacagc

SEQ ID NO: 56348 - DNA, 70 bp, Artificial Sequence
  Synthetic
gccaagcatttaggtgacactataggcaacacatttgggtactaggtttcagagctatgctggaaacagc

SEQ ID NO: 56349 - DNA, 70 bp, Artificial Sequence
  Synthetic
gccaagcatttaggtgacactatagccagggtatctagtacccaagtttcagagctatgctggaaacagc

SEQ ID NO: 56350 - DNA, 70 bp, Artificial Sequence
  Synthetic
gccaagcatttaggtgacactatagccctgtggcacctctcaaaagtttcagagctatgctggaaacagc

SEQ ID NO: 56351 - DNA, 70 bp, Artificial Sequence
  Synthetic
gccaagcatttaggtgacactataggtgtgccctgcccagggggtgtttcagagctatgctggaaacagc

SEQ ID NO: 56352 - DNA, 70 bp, Artificial Sequence
  Synthetic
gccaagcatttaggtgacactataggaccaagtgggctgtcacaggtttcagagctatgctggaaacagc

SEQ ID NO: 56353 - DNA, 70 bp, Artificial Sequence
  Synthetic
gccaagcatttaggtgacactatagtcagaatcatctccccatgcgtttcagagctatgctggaaacagc

SEQ ID NO: 56354 - DNA, 70 bp, Artificial Sequence
  Synthetic
gccaagcatttaggtgacactatagggtccacaggaattcagaatgtttcagagctatgctggaaacagc

SEQ ID NO: 56355 - DNA, 70 bp, Artificial Sequence
  Synthetic
gccaagcatttaggtgacactatagcaccttgggatgttagacttgtttcagagctatgctggaaacagc

SEQ ID NO: 56356 - DNA, 70 bp, Artificial Sequence
  Synthetic
gccaagcatttaggtgacactatagccctgaacaagagacgataggtttcagagctatgctggaaacagc

SEQ ID NO: 56357 - DNA, 70 bp, Artificial Sequence
  Synthetic
gccaagcatttaggtgacactatagttcaacagtgcagatgacatgtttcagagctatgctggaaacagc

SEQ ID NO: 56358 - DNA, 70 bp, Artificial Sequence
  Synthetic
gccaagcatttaggtgacactatagcttagctcttgaagctcttcgtttcagagctatgctggaaacagc

SEQ ID NO: 56359 - DNA, 70 bp, Artificial Sequence
  Synthetic
gccaagcatttaggtgacactataggtgcttatagctcttcctgcgtttcagagctatgctggaaacagc

SEQ ID NO: 56360 - DNA, 70 bp, Artificial Sequence
  Synthetic
gccaagcatttaggtgacactataggtgcttgtagctcttcctgcgtttcagagctatgctggaaacagc

SEQ ID NO: 56361 - DNA, 70 bp, Artificial Sequence
  Synthetic
gccaagcatttaggtgacactatagggtgggaggcggctcagtcggtttcagagctatgctggaaacagc

SEQ ID NO: 56362 - DNA, 70 bp, Artificial Sequence
  Synthetic
gccaagcatttaggtgacactataggggcagtcttctctaccgacgtttcagagctatgctggaaacagc

SEQ ID NO: 56363 - DNA, 70 bp, Artificial Sequence
  Synthetic
gccaagcatttaggtgacactatagccaaccacttgtccatcatcgtttcagagctatgctggaaacagc

SEQ ID NO: 56364 - DNA, 70 bp, Artificial Sequence
  Synthetic
gccaagcatttaggtgacactatagtgtgttgcacttttatctcagtttcagagctatgctggaaacagc

SEQ ID NO: 56365 - DNA, 70 bp, Artificial Sequence
  Synthetic
gccaagcatttaggtgacactataggggtgaggccatgggtctaggtttcagagctatgctggaaacagc

SEQ ID NO: 56366 - DNA, 70 bp, Artificial Sequence
  Synthetic
gccaagcatttaggtgacactatagcttagtgcgtgtagctcttcgtttcagagctatgctggaaacagc

SEQ ID NO: 56367 - DNA, 70 bp, Artificial Sequence
  Synthetic
gccaagcatttaggtgacactatagatttggaacagtagatcactgtttcagagctatgctggaaacagc

SEQ ID NO: 56368 - DNA, 70 bp, Artificial Sequence
  Synthetic
gccaagcatttaggtgacactatagacaggcggatcttggagtaggtttcagagctatgctggaaacagc

SEQ ID NO: 56369 - DNA, 70 bp, Artificial Sequence
  Synthetic
gccaagcatttaggtgacactatagtggctgctgggtcgctcagtgtttcagagctatgctggaaacagc

SEQ ID NO: 56370 - DNA, 70 bp, Artificial Sequence
  Synthetic
gccaagcatttaggtgacactatagggctcagcagctaatacctcgtttcagagctatgctggaaacagc

SEQ ID NO: 56371 - DNA, 70 bp, Artificial Sequence
  Synthetic
gccaagcatttaggtgacactatagggctgccgcagctgttcactgtttcagagctatgctggaaacagc

SEQ ID NO: 56372 - DNA, 70 bp, Artificial Sequence
  Synthetic
gccaagcatttaggtgacactatagcctgatctggaggcagctacgtttcagagctatgctggaaacagc

SEQ ID NO: 56373 - DNA, 70 bp, Artificial Sequence
  Synthetic
gccaagcatttaggtgacactatagtcggaggtctcagagtaagggtttcagagctatgctggaaacagc

SEQ ID NO: 56374 - DNA, 70 bp, Artificial Sequence
  Synthetic
gccaagcatttaggtgacactatagcagcagctgccggaaatgttgtttcagagctatgctggaaacagc

SEQ ID NO: 56375 - DNA, 70 bp, Artificial Sequence
  Synthetic
gccaagcatttaggtgacactatagtcggatcatgctaatgcttggtttcagagctatgctggaaacagc

SEQ ID NO: 56376 - DNA, 70 bp, Artificial Sequence
  Synthetic
gccaagcatttaggtgacactatagcggccaggggaggcattaaggtttcagagctatgctggaaacagc

SEQ ID NO: 56377 - DNA, 70 bp, Artificial Sequence
  Synthetic
gccaagcatttaggtgacactatagggggctgggctctcagtactgtttcagagctatgctggaaacagc

SEQ ID NO: 56378 - DNA, 70 bp, Artificial Sequence
  Synthetic
gccaagcatttaggtgacactatagcatgactctactaggcaaaggtttcagagctatgctggaaacagc

SEQ ID NO: 56379 - DNA, 70 bp, Artificial Sequence
  Synthetic
gccaagcatttaggtgacactatagcagctgtaagaggtgctagggtttcagagctatgctggaaacagc

SEQ ID NO: 56380 - DNA, 70 bp, Artificial Sequence
  Synthetic
gccaagcatttaggtgacactatagttgaggaagaagactaggaagtttcagagctatgctggaaacagc

SEQ ID NO: 56381 - DNA, 70 bp, Artificial Sequence
  Synthetic
gccaagcatttaggtgacactatagagaaggaggttttcaacaaggtttcagagctatgctggaaacagc

SEQ ID NO: 56382 - DNA, 70 bp, Artificial Sequence
  Synthetic
gccaagcatttaggtgacactatagtcagcaaactggcttttagcgtttcagagctatgctggaaacagc

SEQ ID NO: 56383 - DNA, 70 bp, Artificial Sequence
  Synthetic
gccaagcatttaggtgacactatagtcagcaacctggcttttagcgtttcagagctatgctggaaacagc

SEQ ID NO: 56384 - DNA, 70 bp, Artificial Sequence
  Synthetic
gccaagcatttaggtgacactataggcaaactggctttcagcaaggtttcagagctatgctggaaacagc

SEQ ID NO: 56385 - DNA, 70 bp, Artificial Sequence
  Synthetic
gccaagcatttaggtgacactatagaggattgagcactcagcagcgtttcagagctatgctggaaacagc

SEQ ID NO: 56386 - DNA, 70 bp, Artificial Sequence
  Synthetic
gccaagcatttaggtgacactataggccaaaagtctagctgctgagtttcagagctatgctggaaacagc

SEQ ID NO: 56387 - DNA, 70 bp, Artificial Sequence
  Synthetic
gccaagcatttaggtgacactatagccagaagtccagctgctgacgtttcagagctatgctggaaacagc

SEQ ID NO: 56388 - DNA, 70 bp, Artificial Sequence
  Synthetic
gccaagcatttaggtgacactataggggagcacacggggcgtcaggtttcagagctatgctggaaacagc

SEQ ID NO: 56389 - DNA, 70 bp, Artificial Sequence
  Synthetic
gccaagcatttaggtgacactataggcctgagcagaggcctcagcgtttcagagctatgctggaaacagc

SEQ ID NO: 56390 - DNA, 70 bp, Artificial Sequence
  Synthetic
gccaagcatttaggtgacactatagcatccagggctgtcagcagcgtttcagagctatgctggaaacagc

SEQ ID NO: 56391 - DNA, 70 bp, Artificial Sequence
  Synthetic
gccaagcatttaggtgacactatagtaaggagatcactcagcagcgtttcagagctatgctggaaacagc

SEQ ID NO: 56392 - DNA, 70 bp, Artificial Sequence
  Synthetic
gccaagcatttaggtgacactataggccagaagtccagctgctgagtttcagagctatgctggaaacagc

SEQ ID NO: 56393 - DNA, 70 bp, Artificial Sequence
  Synthetic
gccaagcatttaggtgacactatagctggctcctacacacttagcgtttcagagctatgctggaaacagc

SEQ ID NO: 56394 - DNA, 70 bp, Artificial Sequence
  Synthetic
gccaagcatttaggtgacactatagggagattcatgctcagcagcgtttcagagctatgctggaaacagc

SEQ ID NO: 56395 - DNA, 70 bp, Artificial Sequence
  Synthetic
gccaagcatttaggtgacactatagaggagcagctggtcagcagcgtttcagagctatgctggaaacagc

SEQ ID NO: 56396 - DNA, 70 bp, Artificial Sequence
  Synthetic
gccaagcatttaggtgacactatagacccccactggctgctgagcgtttcagagctatgctggaaacagc

SEQ ID NO: 56397 - DNA, 70 bp, Artificial Sequence
  Synthetic
gccaagcatttaggtgacactatagtacagaccaacttgtggatcgtttcagagctatgctggaaacagc

SEQ ID NO: 56398 - DNA, 70 bp, Artificial Sequence
  Synthetic
gccaagcatttaggtgacactatagtcagcaagttgatctgcagagtttcagagctatgctggaaacagc

SEQ ID NO: 56399 - DNA, 70 bp, Artificial Sequence
  Synthetic
gccaagcatttaggtgacactatagtatcagccattctgtagatcgtttcagagctatgctggaaacagc

SEQ ID NO: 56400 - DNA, 70 bp, Artificial Sequence
  Synthetic
gccaagcatttaggtgacactatagtagaagcgagatccacagatgtttcagagctatgctggaaacagc

SEQ ID NO: 56401 - DNA, 70 bp, Artificial Sequence
  Synthetic
gccaagcatttaggtgacactatagctggttagtaacaagttgccgtttcagagctatgctggaaacagc

SEQ ID NO: 56402 - DNA, 70 bp, Artificial Sequence
  Synthetic
gccaagcatttaggtgacactatagttggcaggcttgctggcagcgtttcagagctatgctggaaacagc

SEQ ID NO: 56403 - DNA, 70 bp, Artificial Sequence
  Synthetic
gccaagcatttaggtgacactatagttttgtgtcgcatataggtggtttcagagctatgctggaaacagc

SEQ ID NO: 56404 - DNA, 70 bp, Artificial Sequence
  Synthetic
gccaagcatttaggtgacactatagtctattgccttcagcatcaagtttcagagctatgctggaaacagc

SEQ ID NO: 56405 - DNA, 70 bp, Artificial Sequence
  Synthetic
gccaagcatttaggtgacactatagggccacagaggctgtggagagtttcagagctatgctggaaacagc

SEQ ID NO: 56406 - DNA, 70 bp, Artificial Sequence
  Synthetic
gccaagcatttaggtgacactatagaatttcacacattgtgttgcgtttcagagctatgctggaaacagc

SEQ ID NO: 56407 - DNA, 70 bp, Artificial Sequence
  Synthetic
gccaagcatttaggtgacactatagccctgaggacacgatatcaggtttcagagctatgctggaaacagc

SEQ ID NO: 56408 - DNA, 70 bp, Artificial Sequence
  Synthetic
gccaagcatttaggtgacactatagtatggaggatatggattctcgtttcagagctatgctggaaacagc

SEQ ID NO: 56409 - DNA, 70 bp, Artificial Sequence
  Synthetic
gccaagcatttaggtgacactatagcttgcccgtatgcttcagcagtttcagagctatgctggaaacagc

SEQ ID NO: 56410 - DNA, 70 bp, Artificial Sequence
  Synthetic
gccaagcatttaggtgacactatagtatgggggatactggtcttcgtttcagagctatgctggaaacagc

SEQ ID NO: 56411 - DNA, 70 bp, Artificial Sequence
  Synthetic
gccaagcatttaggtgacactatagtgagttcactcttcagtagagtttcagagctatgctggaaacagc

SEQ ID NO: 56412 - DNA, 70 bp, Artificial Sequence
  Synthetic
gccaagcatttaggtgacactataggcagcaggtggtggctcagcgtttcagagctatgctggaaacagc

SEQ ID NO: 56413 - DNA, 70 bp, Artificial Sequence
  Synthetic
gccaagcatttaggtgacactatagaggagaggtggggtctcagcgtttcagagctatgctggaaacagc

SEQ ID NO: 56414 - DNA, 70 bp, Artificial Sequence
  Synthetic
gccaagcatttaggtgacactataggggggcattggggtctcagcgtttcagagctatgctggaaacagc

SEQ ID NO: 56415 - DNA, 70 bp, Artificial Sequence
  Synthetic
gccaagcatttaggtgacactatagtactactgcccatcttgctagtttcagagctatgctggaaacagc

SEQ ID NO: 56416 - DNA, 70 bp, Artificial Sequence
  Synthetic
gccaagcatttaggtgacactataggcaaatttaggaagtccatggtttcagagctatgctggaaacagc

SEQ ID NO: 56417 - DNA, 70 bp, Artificial Sequence
  Synthetic
gccaagcatttaggtgacactataggatgtggctgtggtggggtagtttcagagctatgctggaaacagc

SEQ ID NO: 56418 - DNA, 70 bp, Artificial Sequence
  Synthetic
gccaagcatttaggtgacactataggaatccatggtgtcattaccgtttcagagctatgctggaaacagc

SEQ ID NO: 56419 - DNA, 70 bp, Artificial Sequence
  Synthetic
gccaagcatttaggtgacactatagtgctaaaacatcactgtcgggtttcagagctatgctggaaacagc

SEQ ID NO: 56420 - DNA, 70 bp, Artificial Sequence
  Synthetic
gccaagcatttaggtgacactatagtagtgatgattagtagcaaggtttcagagctatgctggaaacagc

SEQ ID NO: 56421 - DNA, 70 bp, Artificial Sequence
  Synthetic
gccaagcatttaggtgacactatagtgtggctgtaacggttattagtttcagagctatgctggaaacagc

SEQ ID NO: 56422 - DNA, 70 bp, Artificial Sequence
  Synthetic
gccaagcatttaggtgacactatagtagagattgctgatctgtttgtttcagagctatgctggaaacagc

SEQ ID NO: 56423 - DNA, 70 bp, Artificial Sequence
  Synthetic
gccaagcatttaggtgacactatagatttctttctaggagccaatgtttcagagctatgctggaaacagc

SEQ ID NO: 56424 - DNA, 70 bp, Artificial Sequence
  Synthetic
gccaagcatttaggtgacactataggggctttcaggagacttgctgtttcagagctatgctggaaacagc

SEQ ID NO: 56425 - DNA, 70 bp, Artificial Sequence
  Synthetic
gccaagcatttaggtgacactataggttggtcaatagcatttcaggtttcagagctatgctggaaacagc

SEQ ID NO: 56426 - DNA, 70 bp, Artificial Sequence
  Synthetic
gccaagcatttaggtgacactatagcttgttctgattttgtgggtgtttcagagctatgctggaaacagc

SEQ ID NO: 56427 - DNA, 70 bp, Artificial Sequence
  Synthetic
gccaagcatttaggtgacactatagacgtgtcgtccatcttgctcgtttcagagctatgctggaaacagc

SEQ ID NO: 56428 - DNA, 70 bp, Artificial Sequence
  Synthetic
gccaagcatttaggtgacactatagcctacagatcttcacttactgtttcagagctatgctggaaacagc

SEQ ID NO: 56429 - DNA, 70 bp, Artificial Sequence
  Synthetic
gccaagcatttaggtgacactatagctgtgagtccagcttctgcagtttcagagctatgctggaaacagc

SEQ ID NO: 56430 - DNA, 70 bp, Artificial Sequence
  Synthetic
gccaagcatttaggtgacactatagcagactcggctggttaacaggtttcagagctatgctggaaacagc

SEQ ID NO: 56431 - DNA, 70 bp, Artificial Sequence
  Synthetic
gccaagcatttaggtgacactataggcctcccaagaggctgctgagtttcagagctatgctggaaacagc

SEQ ID NO: 56432 - DNA, 70 bp, Artificial Sequence
  Synthetic
gccaagcatttaggtgacactataggcctcccaagaggctgctaagtttcagagctatgctggaaacagc

SEQ ID NO: 56433 - DNA, 70 bp, Artificial Sequence
  Synthetic
gccaagcatttaggtgacactatagccaatatgaggttcaacaaggtttcagagctatgctggaaacagc

SEQ ID NO: 56434 - DNA, 70 bp, Artificial Sequence
  Synthetic
gccaagcatttaggtgacactatagagcagagatttagcagcaaggtttcagagctatgctggaaacagc

SEQ ID NO: 56435 - DNA, 70 bp, Artificial Sequence
  Synthetic
gccaagcatttaggtgacactatagtgccgcccaacctgctctaggtttcagagctatgctggaaacagc

SEQ ID NO: 56436 - DNA, 70 bp, Artificial Sequence
  Synthetic
gccaagcatttaggtgacactatagtgcttccaccccatctgctggtttcagagctatgctggaaacagc

SEQ ID NO: 56437 - DNA, 70 bp, Artificial Sequence
  Synthetic
gccaagcatttaggtgacactatagtgggctagcagcatagagacgtttcagagctatgctggaaacagc

SEQ ID NO: 56438 - DNA, 70 bp, Artificial Sequence
  Synthetic
gccaagcatttaggtgacactatagaaggagacattagcagcaaggtttcagagctatgctggaaacagc

SEQ ID NO: 56439 - DNA, 70 bp, Artificial Sequence
  Synthetic
gccaagcatttaggtgacactataggcaaggagctcagcagcaaggtttcagagctatgctggaaacagc

SEQ ID NO: 56440 - DNA, 70 bp, Artificial Sequence
  Synthetic
gccaagcatttaggtgacactataggcagtgggctcagcagcaaggtttcagagctatgctggaaacagc

SEQ ID NO: 56441 - DNA, 70 bp, Artificial Sequence
  Synthetic
gccaagcatttaggtgacactatagccagaaatcagatcttgcacgtttcagagctatgctggaaacagc

SEQ ID NO: 56442 - DNA, 70 bp, Artificial Sequence
  Synthetic
gccaagcatttaggtgacactatagtgctgccagtgtaagatctggtttcagagctatgctggaaacagc

SEQ ID NO: 56443 - DNA, 70 bp, Artificial Sequence
  Synthetic
gccaagcatttaggtgacactatagtgctgccagtgcaaaatctggtttcagagctatgctggaaacagc

SEQ ID NO: 56444 - DNA, 70 bp, Artificial Sequence
  Synthetic
gccaagcatttaggtgacactatagtgctgccagtgcaagatctggtttcagagctatgctggaaacagc

SEQ ID NO: 56445 - DNA, 70 bp, Artificial Sequence
  Synthetic
gccaagcatttaggtgacactatagtgctaccagtgcaagatctggtttcagagctatgctggaaacagc

SEQ ID NO: 56446 - DNA, 70 bp, Artificial Sequence
  Synthetic
gccaagcatttaggtgacactatagggctctggctactattattggtttcagagctatgctggaaacagc

SEQ ID NO: 56447 - DNA, 70 bp, Artificial Sequence
  Synthetic
gccaagcatttaggtgacactatagtgtggctatggatgcggctcgtttcagagctatgctggaaacagc

SEQ ID NO: 56448 - DNA, 70 bp, Artificial Sequence
  Synthetic
gccaagcatttaggtgacactataggagcatgtgggcttcagaatgtttcagagctatgctggaaacagc

SEQ ID NO: 56449 - DNA, 70 bp, Artificial Sequence
  Synthetic
gccaagcatttaggtgacactatagggagccattggtccatcagtgtttcagagctatgctggaaacagc

SEQ ID NO: 56450 - DNA, 70 bp, Artificial Sequence
  Synthetic
gccaagcatttaggtgacactatagtgtcccagagaacatcagccgtttcagagctatgctggaaacagc

SEQ ID NO: 56451 - DNA, 70 bp, Artificial Sequence
  Synthetic
gccaagcatttaggtgacactatagcagcagctggagacacagcagtttcagagctatgctggaaacagc

SEQ ID NO: 56452 - DNA, 70 bp, Artificial Sequence
  Synthetic
gccaagcatttaggtgacactatagggagttgattagcagcaagagtttcagagctatgctggaaacagc

SEQ ID NO: 56453 - DNA, 70 bp, Artificial Sequence
  Synthetic
gccaagcatttaggtgacactatagggacttgatcagcagcaaaagtttcagagctatgctggaaacagc

SEQ ID NO: 56454 - DNA, 70 bp, Artificial Sequence
  Synthetic
gccaagcatttaggtgacactatagacaagaatgctggcagcagcgtttcagagctatgctggaaacagc

SEQ ID NO: 56455 - DNA, 70 bp, Artificial Sequence
  Synthetic
gccaagcatttaggtgacactataggcaagcaggctgacagcagcgtttcagagctatgctggaaacagc

SEQ ID NO: 56456 - DNA, 70 bp, Artificial Sequence
  Synthetic
gccaagcatttaggtgacactataggaacgtgatcagcagcaagagtttcagagctatgctggaaacagc

SEQ ID NO: 56457 - DNA, 70 bp, Artificial Sequence
  Synthetic
gccaagcatttaggtgacactatagggacttgatcagcagcaagagtttcagagctatgctggaaacagc

SEQ ID NO: 56458 - DNA, 70 bp, Artificial Sequence
  Synthetic
gccaagcatttaggtgacactatagctcacaccagccaaggtcacgtttcagagctatgctggaaacagc

SEQ ID NO: 56459 - DNA, 70 bp, Artificial Sequence
  Synthetic
gccaagcatttaggtgacactatagatcacagagaagttgggtttgtttcagagctatgctggaaacagc

SEQ ID NO: 56460 - DNA, 70 bp, Artificial Sequence
  Synthetic
gccaagcatttaggtgacactatagccagtggaggtcatggtcacgtttcagagctatgctggaaacagc

SEQ ID NO: 56461 - DNA, 70 bp, Artificial Sequence
  Synthetic
gccaagcatttaggtgacactatagtctcccaccctggacacttcgtttcagagctatgctggaaacagc

SEQ ID NO: 56462 - DNA, 70 bp, Artificial Sequence
  Synthetic
gccaagcatttaggtgacactatagtgtctcaccctggacatttcgtttcagagctatgctggaaacagc

SEQ ID NO: 56463 - DNA, 70 bp, Artificial Sequence
  Synthetic
gccaagcatttaggtgacactatagctacctcctctggtcagtgcgtttcagagctatgctggaaacagc

SEQ ID NO: 56464 - DNA, 70 bp, Artificial Sequence
  Synthetic
gccaagcatttaggtgacactatagaaaggagaaagagcactaccgtttcagagctatgctggaaacagc

SEQ ID NO: 56465 - DNA, 70 bp, Artificial Sequence
  Synthetic
gccaagcatttaggtgacactatagacagatgacgaggagatgacgtttcagagctatgctggaaacagc

SEQ ID NO: 56466 - DNA, 70 bp, Artificial Sequence
  Synthetic
gccaagcatttaggtgacactataggaccggggcacagccctcacgtttcagagctatgctggaaacagc

SEQ ID NO: 56467 - DNA, 70 bp, Artificial Sequence
  Synthetic
gccaagcatttaggtgacactatagggccataggccacatcagcagtttcagagctatgctggaaacagc

SEQ ID NO: 56468 - DNA, 70 bp, Artificial Sequence
  Synthetic
gccaagcatttaggtgacactataggaagctgcggaagtggaagggtttcagagctatgctggaaacagc

SEQ ID NO: 56469 - DNA, 70 bp, Artificial Sequence
  Synthetic
gccaagcatttaggtgacactatagctgaagaaatcatcaaggcagtttcagagctatgctggaaacagc

SEQ ID NO: 56470 - DNA, 70 bp, Artificial Sequence
  Synthetic
gccaagcatttaggtgacactatagaagtatagaagtgagcagatgtttcagagctatgctggaaacagc

SEQ ID NO: 56471 - DNA, 70 bp, Artificial Sequence
  Synthetic
gccaagcatttaggtgacactatagggcatgcttttcatgaatgagtttcagagctatgctggaaacagc

SEQ ID NO: 56472 - DNA, 70 bp, Artificial Sequence
  Synthetic
gccaagcatttaggtgacactatagctgccgtggccctagaataggtttcagagctatgctggaaacagc

SEQ ID NO: 56473 - DNA, 70 bp, Artificial Sequence
  Synthetic
gccaagcatttaggtgacactatagccaccttgagagaattactggtttcagagctatgctggaaacagc

SEQ ID NO: 56474 - DNA, 70 bp, Artificial Sequence
  Synthetic
gccaagcatttaggtgacactatagacttcttccattgcaatttcgtttcagagctatgctggaaacagc

SEQ ID NO: 56475 - DNA, 70 bp, Artificial Sequence
  Synthetic
gccaagcatttaggtgacactatagattgcaaggtttcgcggagtgtttcagagctatgctggaaacagc

SEQ ID NO: 56476 - DNA, 70 bp, Artificial Sequence
  Synthetic
gccaagcatttaggtgacactatagatttatcaaacacccaactcgtttcagagctatgctggaaacagc

SEQ ID NO: 56477 - DNA, 70 bp, Artificial Sequence
  Synthetic
gccaagcatttaggtgacactataggatgacgacccattgagggagtttcagagctatgctggaaacagc

SEQ ID NO: 56478 - DNA, 70 bp, Artificial Sequence
  Synthetic
gccaagcatttaggtgacactatagatcactggcaaagctaagttgtttcagagctatgctggaaacagc

SEQ ID NO: 56479 - DNA, 70 bp, Artificial Sequence
  Synthetic
gccaagcatttaggtgacactatagctccgtcgagaacatcaagcgtttcagagctatgctggaaacagc

SEQ ID NO: 56480 - DNA, 70 bp, Artificial Sequence
  Synthetic
gccaagcatttaggtgacactatagtctctgcagctttgaacatcgtttcagagctatgctggaaacagc

SEQ ID NO: 56481 - DNA, 70 bp, Artificial Sequence
  Synthetic
gccaagcatttaggtgacactatagcaagaagtcaggggatgaatgtttcagagctatgctggaaacagc

SEQ ID NO: 56482 - DNA, 70 bp, Artificial Sequence
  Synthetic
gccaagcatttaggtgacactataggtccgagatggccttaatttgtttcagagctatgctggaaacagc

SEQ ID NO: 56483 - DNA, 70 bp, Artificial Sequence
  Synthetic
gccaagcatttaggtgacactatagtttctctcttgcagtcagttgtttcagagctatgctggaaacagc

SEQ ID NO: 56484 - DNA, 70 bp, Artificial Sequence
  Synthetic
gccaagcatttaggtgacactatagttttcagcttctcatgcccagtttcagagctatgctggaaacagc

SEQ ID NO: 56485 - DNA, 70 bp, Artificial Sequence
  Synthetic
gccaagcatttaggtgacactatagggatatgctgacgactgtgcgtttcagagctatgctggaaacagc

SEQ ID NO: 56486 - DNA, 70 bp, Artificial Sequence
  Synthetic
gccaagcatttaggtgacactatagtctctactatggctgccagtgtttcagagctatgctggaaacagc

SEQ ID NO: 56487 - DNA, 70 bp, Artificial Sequence
  Synthetic
gccaagcatttaggtgacactatagttcaagggcaatcttcaaaggtttcagagctatgctggaaacagc

SEQ ID NO: 56488 - DNA, 70 bp, Artificial Sequence
  Synthetic
gccaagcatttaggtgacactatagacacagatcctgacaagaaagtttcagagctatgctggaaacagc

SEQ ID NO: 56489 - DNA, 70 bp, Artificial Sequence
  Synthetic
gccaagcatttaggtgacactataggctgcggctgcggggcaagcgtttcagagctatgctggaaacagc

SEQ ID NO: 56490 - DNA, 70 bp, Artificial Sequence
  Synthetic
gccaagcatttaggtgacactatagtgactcctcgctggacgctggtttcagagctatgctggaaacagc

SEQ ID NO: 56491 - DNA, 70 bp, Artificial Sequence
  Synthetic
gccaagcatttaggtgacactataggagccggagcagctctgaccgtttcagagctatgctggaaacagc

SEQ ID NO: 56492 - DNA, 70 bp, Artificial Sequence
  Synthetic
gccaagcatttaggtgacactatagtttgcccaggccaggcttaggtttcagagctatgctggaaacagc

SEQ ID NO: 56493 - DNA, 70 bp, Artificial Sequence
  Synthetic
gccaagcatttaggtgacactataggtgggtatggggtcagtgtcgtttcagagctatgctggaaacagc

SEQ ID NO: 56494 - DNA, 70 bp, Artificial Sequence
  Synthetic
gccaagcatttaggtgacactatagcattcatggtgcatcaaatcgtttcagagctatgctggaaacagc

SEQ ID NO: 56495 - DNA, 70 bp, Artificial Sequence
  Synthetic
gccaagcatttaggtgacactataggcactgagaagctggaacaggtttcagagctatgctggaaacagc

SEQ ID NO: 56496 - DNA, 70 bp, Artificial Sequence
  Synthetic
gccaagcatttaggtgacactatagtctgcttgaagttcaggactgtttcagagctatgctggaaacagc

SEQ ID NO: 56497 - DNA, 70 bp, Artificial Sequence
  Synthetic
gccaagcatttaggtgacactatagtagttggctgggcatgatacgtttcagagctatgctggaaacagc

SEQ ID NO: 56498 - DNA, 70 bp, Artificial Sequence
  Synthetic
gccaagcatttaggtgacactatagagagactgtgtaagtgactggtttcagagctatgctggaaacagc

SEQ ID NO: 56499 - DNA, 70 bp, Artificial Sequence
  Synthetic
gccaagcatttaggtgacactataggtgaaataggcttgggttacgtttcagagctatgctggaaacagc

SEQ ID NO: 56500 - DNA, 70 bp, Artificial Sequence
  Synthetic
gccaagcatttaggtgacactataggctctgtcatgtcaggctgcgtttcagagctatgctggaaacagc

SEQ ID NO: 56501 - DNA, 70 bp, Artificial Sequence
  Synthetic
gccaagcatttaggtgacactatagtcacctgggctaggtcagttgtttcagagctatgctggaaacagc

SEQ ID NO: 56502 - DNA, 70 bp, Artificial Sequence
  Synthetic
gccaagcatttaggtgacactatagggggttggctgtgtcctagggtttcagagctatgctggaaacagc

SEQ ID NO: 56503 - DNA, 70 bp, Artificial Sequence
  Synthetic
gccaagcatttaggtgacactatagtgctatacacagcaactttcgtttcagagctatgctggaaacagc

SEQ ID NO: 56504 - DNA, 70 bp, Artificial Sequence
  Synthetic
gccaagcatttaggtgacactatagaggccttgggcaggggtcacgtttcagagctatgctggaaacagc

SEQ ID NO: 56505 - DNA, 70 bp, Artificial Sequence
  Synthetic
gccaagcatttaggtgacactataggaagctgtagcatcacttgcgtttcagagctatgctggaaacagc

SEQ ID NO: 56506 - DNA, 70 bp, Artificial Sequence
  Synthetic
gccaagcatttaggtgacactatagcaggagaattgcttgcactcgtttcagagctatgctggaaacagc

SEQ ID NO: 56507 - DNA, 70 bp, Artificial Sequence
  Synthetic
gccaagcatttaggtgacactatagaagctttaaagtatcttgccgtttcagagctatgctggaaacagc

SEQ ID NO: 56508 - DNA, 70 bp, Artificial Sequence
  Synthetic
gccaagcatttaggtgacactatagatatgctaggtgctatagctgtttcagagctatgctggaaacagc

SEQ ID NO: 56509 - DNA, 70 bp, Artificial Sequence
  Synthetic
gccaagcatttaggtgacactatagaagacactagggcttttcaagtttcagagctatgctggaaacagc

SEQ ID NO: 56510 - DNA, 70 bp, Artificial Sequence
  Synthetic
gccaagcatttaggtgacactataggacggcctcctgcatctgatgtttcagagctatgctggaaacagc

SEQ ID NO: 56511 - DNA, 70 bp, Artificial Sequence
  Synthetic
gccaagcatttaggtgacactatagttcactgttgctcaagagccgtttcagagctatgctggaaacagc

SEQ ID NO: 56512 - DNA, 70 bp, Artificial Sequence
  Synthetic
gccaagcatttaggtgacactatagactgtgccagctggcagtgagtttcagagctatgctggaaacagc

SEQ ID NO: 56513 - DNA, 70 bp, Artificial Sequence
  Synthetic
gccaagcatttaggtgacactatagggctaccagactatctagccgtttcagagctatgctggaaacagc

SEQ ID NO: 56514 - DNA, 70 bp, Artificial Sequence
  Synthetic
gccaagcatttaggtgacactatagggaagaaggaaaagtcgtacgtttcagagctatgctggaaacagc

SEQ ID NO: 56515 - DNA, 70 bp, Artificial Sequence
  Synthetic
gccaagcatttaggtgacactatagggtctcaagcaccatcatgcgtttcagagctatgctggaaacagc

SEQ ID NO: 56516 - DNA, 70 bp, Artificial Sequence
  Synthetic
gccaagcatttaggtgacactatagggcagaagaaaaagttatgcgtttcagagctatgctggaaacagc

SEQ ID NO: 56517 - DNA, 70 bp, Artificial Sequence
  Synthetic
gccaagcatttaggtgacactatagcgggcaacaattagattctcgtttcagagctatgctggaaacagc

SEQ ID NO: 56518 - DNA, 70 bp, Artificial Sequence
  Synthetic
gccaagcatttaggtgacactatagagtataagcacatgggctaggtttcagagctatgctggaaacagc

SEQ ID NO: 56519 - DNA, 70 bp, Artificial Sequence
  Synthetic
gccaagcatttaggtgacactatagccaaggacccctctcttcatgtttcagagctatgctggaaacagc

SEQ ID NO: 56520 - DNA, 70 bp, Artificial Sequence
  Synthetic
gccaagcatttaggtgacactatagcccaagtggcggcatcttaagtttcagagctatgctggaaacagc

SEQ ID NO: 56521 - DNA, 70 bp, Artificial Sequence
  Synthetic
gccaagcatttaggtgacactatagtgaagaactgagacaagttggtttcagagctatgctggaaacagc

SEQ ID NO: 56522 - DNA, 70 bp, Artificial Sequence
  Synthetic
gccaagcatttaggtgacactatagagaacacacactgctggtgagtttcagagctatgctggaaacagc

SEQ ID NO: 56523 - DNA, 70 bp, Artificial Sequence
  Synthetic
gccaagcatttaggtgacactatagccggcaggctcagacatcaagtttcagagctatgctggaaacagc

SEQ ID NO: 56524 - DNA, 70 bp, Artificial Sequence
  Synthetic
gccaagcatttaggtgacactataggaacagatatgagcatcaaggtttcagagctatgctggaaacagc

SEQ ID NO: 56525 - DNA, 70 bp, Artificial Sequence
  Synthetic
gccaagcatttaggtgacactatagccctgcatttgaactctgaagtttcagagctatgctggaaacagc

SEQ ID NO: 56526 - DNA, 70 bp, Artificial Sequence
  Synthetic
gccaagcatttaggtgacactatagctcttcgaagagggattaaagtttcagagctatgctggaaacagc

SEQ ID NO: 56527 - DNA, 70 bp, Artificial Sequence
  Synthetic
gccaagcatttaggtgacactatagctgctgctgtaccggctcacgtttcagagctatgctggaaacagc

SEQ ID NO: 56528 - DNA, 70 bp, Artificial Sequence
  Synthetic
gccaagcatttaggtgacactatagcttcagcgtctttgtttagagtttcagagctatgctggaaacagc

SEQ ID NO: 56529 - DNA, 70 bp, Artificial Sequence
  Synthetic
gccaagcatttaggtgacactataggaactcaatgagagtccttggtttcagagctatgctggaaacagc

SEQ ID NO: 56530 - DNA, 70 bp, Artificial Sequence
  Synthetic
gccaagcatttaggtgacactatagaaggcagaatttcttcaggcgtttcagagctatgctggaaacagc

SEQ ID NO: 56531 - DNA, 70 bp, Artificial Sequence
  Synthetic
gccaagcatttaggtgacactatagaaggcttaggcagacacgtagtttcagagctatgctggaaacagc

SEQ ID NO: 56532 - DNA, 70 bp, Artificial Sequence
  Synthetic
gccaagcatttaggtgacactatagagcaccacccccatactcaggtttcagagctatgctggaaacagc

SEQ ID NO: 56533 - DNA, 70 bp, Artificial Sequence
  Synthetic
gccaagcatttaggtgacactatagttggtgctagctgttgttctgtttcagagctatgctggaaacagc

SEQ ID NO: 56534 - DNA, 70 bp, Artificial Sequence
  Synthetic
gccaagcatttaggtgacactatagcagagccctgcccgaggctggtttcagagctatgctggaaacagc

SEQ ID NO: 56535 - DNA, 70 bp, Artificial Sequence
  Synthetic
gccaagcatttaggtgacactatagcactcgaacacacagactttgtttcagagctatgctggaaacagc

SEQ ID NO: 56536 - DNA, 70 bp, Artificial Sequence
  Synthetic
gccaagcatttaggtgacactatagaagcatcagtagaaagatgtgtttcagagctatgctggaaacagc

SEQ ID NO: 56537 - DNA, 70 bp, Artificial Sequence
  Synthetic
gccaagcatttaggtgacactatagcgatgtaacagtgggttattgtttcagagctatgctggaaacagc

SEQ ID NO: 56538 - DNA, 70 bp, Artificial Sequence
  Synthetic
gccaagcatttaggtgacactatagctgtatgtgagcaaaaggctgtttcagagctatgctggaaacagc

SEQ ID NO: 56539 - DNA, 70 bp, Artificial Sequence
  Synthetic
gccaagcatttaggtgacactatagtgtgaattgtcactggactcgtttcagagctatgctggaaacagc

SEQ ID NO: 56540 - DNA, 70 bp, Artificial Sequence
  Synthetic
gccaagcatttaggtgacactatagatggggactatggtaggggcgtttcagagctatgctggaaacagc

SEQ ID NO: 56541 - DNA, 70 bp, Artificial Sequence
  Synthetic
gccaagcatttaggtgacactatagaatgctgctgctatgaatatgtttcagagctatgctggaaacagc

SEQ ID NO: 56542 - DNA, 70 bp, Artificial Sequence
  Synthetic
gccaagcatttaggtgacactataggaagcagtacttgccctcgagtttcagagctatgctggaaacagc

SEQ ID NO: 56543 - DNA, 70 bp, Artificial Sequence
  Synthetic
gccaagcatttaggtgacactatagttttactttggtgatctggggtttcagagctatgctggaaacagc

SEQ ID NO: 56544 - DNA, 70 bp, Artificial Sequence
  Synthetic
gccaagcatttaggtgacactatagcagacgtacggttttcactggtttcagagctatgctggaaacagc

SEQ ID NO: 56545 - DNA, 70 bp, Artificial Sequence
  Synthetic
gccaagcatttaggtgacactatagtagcacagcacccagcacatgtttcagagctatgctggaaacagc

SEQ ID NO: 56546 - DNA, 70 bp, Artificial Sequence
  Synthetic
gccaagcatttaggtgacactatagtcatggccatgagaggagcagtttcagagctatgctggaaacagc

SEQ ID NO: 56547 - DNA, 70 bp, Artificial Sequence
  Synthetic
gccaagcatttaggtgacactatagcagcctcgggaaaagaaaaggtttcagagctatgctggaaacagc

SEQ ID NO: 56548 - DNA, 70 bp, Artificial Sequence
  Synthetic
gccaagcatttaggtgacactatagtggcgatacaataatctatcgtttcagagctatgctggaaacagc

SEQ ID NO: 56549 - DNA, 70 bp, Artificial Sequence
  Synthetic
gccaagcatttaggtgacactatagctggctgtcaatcttgcaccgtttcagagctatgctggaaacagc

SEQ ID NO: 56550 - DNA, 70 bp, Artificial Sequence
  Synthetic
gccaagcatttaggtgacactatagctggcctgcagctcttctgagtttcagagctatgctggaaacagc

SEQ ID NO: 56551 - DNA, 70 bp, Artificial Sequence
  Synthetic
gccaagcatttaggtgacactataggggggcgctgcgggttcagagtttcagagctatgctggaaacagc

SEQ ID NO: 56552 - DNA, 70 bp, Artificial Sequence
  Synthetic
gccaagcatttaggtgacactatagatctgcaggagctgaactgagtttcagagctatgctggaaacagc

SEQ ID NO: 56553 - DNA, 70 bp, Artificial Sequence
  Synthetic
gccaagcatttaggtgacactataggtggcagccacagaagcctagtttcagagctatgctggaaacagc

SEQ ID NO: 56554 - DNA, 70 bp, Artificial Sequence
  Synthetic
gccaagcatttaggtgacactatagacaaggctcagagcagcagtgtttcagagctatgctggaaacagc

SEQ ID NO: 56555 - DNA, 70 bp, Artificial Sequence
  Synthetic
gccaagcatttaggtgacactatagcaagaaagatgaagagcgaagtttcagagctatgctggaaacagc

SEQ ID NO: 56556 - DNA, 70 bp, Artificial Sequence
  Synthetic
gccaagcatttaggtgacactatagcagcctgtgtacgtgtagatgtttcagagctatgctggaaacagc

SEQ ID NO: 56557 - DNA, 70 bp, Artificial Sequence
  Synthetic
gccaagcatttaggtgacactatagtacctgggtcttcattcatcgtttcagagctatgctggaaacagc

SEQ ID NO: 56558 - DNA, 70 bp, Artificial Sequence
  Synthetic
gccaagcatttaggtgacactataggagtaaggagtctggatggggtttcagagctatgctggaaacagc

SEQ ID NO: 56559 - DNA, 70 bp, Artificial Sequence
  Synthetic
gccaagcatttaggtgacactatagtcctggtcttgctgtgtgatgtttcagagctatgctggaaacagc

SEQ ID NO: 56560 - DNA, 70 bp, Artificial Sequence
  Synthetic
gccaagcatttaggtgacactataggagctgtggttcactagtccgtttcagagctatgctggaaacagc

SEQ ID NO: 56561 - DNA, 70 bp, Artificial Sequence
  Synthetic
gccaagcatttaggtgacactataggtccaatacatgagagtttggtttcagagctatgctggaaacagc

SEQ ID NO: 56562 - DNA, 70 bp, Artificial Sequence
  Synthetic
gccaagcatttaggtgacactataggaagaaatacggcgtggcttgtttcagagctatgctggaaacagc

SEQ ID NO: 56563 - DNA, 70 bp, Artificial Sequence
  Synthetic
gccaagcatttaggtgacactataggatcgacgtggacgattgaggtttcagagctatgctggaaacagc

SEQ ID NO: 56564 - DNA, 70 bp, Artificial Sequence
  Synthetic
gccaagcatttaggtgacactataggtcagacgaggagatacagggtttcagagctatgctggaaacagc

SEQ ID NO: 56565 - DNA, 70 bp, Artificial Sequence
  Synthetic
gccaagcatttaggtgacactataggaatcagctgcttttactgcgtttcagagctatgctggaaacagc

SEQ ID NO: 56566 - DNA, 70 bp, Artificial Sequence
  Synthetic
gccaagcatttaggtgacactatagaagccatcgtcacctacagagtttcagagctatgctggaaacagc

SEQ ID NO: 56567 - DNA, 70 bp, Artificial Sequence
  Synthetic
gccaagcatttaggtgacactataggcaaaggaaggtctttattcgtttcagagctatgctggaaacagc

SEQ ID NO: 56568 - DNA, 70 bp, Artificial Sequence
  Synthetic
gccaagcatttaggtgacactatagtctggaggctgctgctaaaggtttcagagctatgctggaaacagc

SEQ ID NO: 56569 - DNA, 70 bp, Artificial Sequence
  Synthetic
gccaagcatttaggtgacactatagtctggaggctgctgctgaaggtttcagagctatgctggaaacagc

SEQ ID NO: 56570 - DNA, 70 bp, Artificial Sequence
  Synthetic
gccaagcatttaggtgacactatagtggctgctgccacagctctggtttcagagctatgctggaaacagc

SEQ ID NO: 56571 - DNA, 70 bp, Artificial Sequence
  Synthetic
gccaagcatttaggtgacactatagtctgggggctgctgctgaccgtttcagagctatgctggaaacagc

SEQ ID NO: 56572 - DNA, 70 bp, Artificial Sequence
  Synthetic
gccaagcatttaggtgacactatagagctgtggccacagttctgcgtttcagagctatgctggaaacagc

SEQ ID NO: 56573 - DNA, 70 bp, Artificial Sequence
  Synthetic
gccaagcatttaggtgacactataggactgtggctatggctctgggtttcagagctatgctggaaacagc

SEQ ID NO: 56574 - DNA, 70 bp, Artificial Sequence
  Synthetic
gccaagcatttaggtgacactatagggctgctgccacggttctgggtttcagagctatgctggaaacagc

SEQ ID NO: 56575 - DNA, 70 bp, Artificial Sequence
  Synthetic
gccaagcatttaggtgacactatagggagggggctgttgctgaccgtttcagagctatgctggaaacagc

SEQ ID NO: 56576 - DNA, 70 bp, Artificial Sequence
  Synthetic
gccaagcatttaggtgacactatagtctggaggctgctgctgaccgtttcagagctatgctggaaacagc

SEQ ID NO: 56577 - DNA, 70 bp, Artificial Sequence
  Synthetic
gccaagcatttaggtgacactatagtgcaaagaggaagagtgtgagtttcagagctatgctggaaacagc

SEQ ID NO: 56578 - DNA, 70 bp, Artificial Sequence
  Synthetic
gccaagcatttaggtgacactataggtaccagcctcagccttgaggtttcagagctatgctggaaacagc

SEQ ID NO: 56579 - DNA, 70 bp, Artificial Sequence
  Synthetic
gccaagcatttaggtgacactataggtggctgtttgtgtaaaagtgtttcagagctatgctggaaacagc

SEQ ID NO: 56580 - DNA, 70 bp, Artificial Sequence
  Synthetic
gccaagcatttaggtgacactatagaccaaaggaggaaatgagctgtttcagagctatgctggaaacagc

SEQ ID NO: 56581 - DNA, 70 bp, Artificial Sequence
  Synthetic
gccaagcatttaggtgacactatagtccttaagtgctgggcagtagtttcagagctatgctggaaacagc

SEQ ID NO: 56582 - DNA, 70 bp, Artificial Sequence
  Synthetic
gccaagcatttaggtgacactataggaagctctttatggagaaccgtttcagagctatgctggaaacagc

SEQ ID NO: 56583 - DNA, 70 bp, Artificial Sequence
  Synthetic
gccaagcatttaggtgacactatagtgctctccagggagcgattagtttcagagctatgctggaaacagc

SEQ ID NO: 56584 - DNA, 70 bp, Artificial Sequence
  Synthetic
gccaagcatttaggtgacactatagaggacgctggctctcatggcgtttcagagctatgctggaaacagc

SEQ ID NO: 56585 - DNA, 70 bp, Artificial Sequence
  Synthetic
gccaagcatttaggtgacactatagcccaggccagcgtctgttgagtttcagagctatgctggaaacagc

SEQ ID NO: 56586 - DNA, 70 bp, Artificial Sequence
  Synthetic
gccaagcatttaggtgacactatagatgcaaccctgagagcaagggtttcagagctatgctggaaacagc

SEQ ID NO: 56587 - DNA, 70 bp, Artificial Sequence
  Synthetic
gccaagcatttaggtgacactataggcactcagccgtcgatacacgtttcagagctatgctggaaacagc

SEQ ID NO: 56588 - DNA, 70 bp, Artificial Sequence
  Synthetic
gccaagcatttaggtgacactataggggcttcctgtcacagtagcgtttcagagctatgctggaaacagc

SEQ ID NO: 56589 - DNA, 70 bp, Artificial Sequence
  Synthetic
gccaagcatttaggtgacactataggtgtgccgagctcctgaagggtttcagagctatgctggaaacagc

SEQ ID NO: 56590 - DNA, 70 bp, Artificial Sequence
  Synthetic
gccaagcatttaggtgacactatagagcattacaggagcccgcccgtttcagagctatgctggaaacagc

SEQ ID NO: 56591 - DNA, 70 bp, Artificial Sequence
  Synthetic
gccaagcatttaggtgacactatagagccatcttcatggtgtcctgtttcagagctatgctggaaacagc

SEQ ID NO: 56592 - DNA, 70 bp, Artificial Sequence
  Synthetic
gccaagcatttaggtgacactataggcggctggatgcaaagtgatgtttcagagctatgctggaaacagc

SEQ ID NO: 56593 - DNA, 70 bp, Artificial Sequence
  Synthetic
gccaagcatttaggtgacactatagcactttgtgctgcctctcccgtttcagagctatgctggaaacagc

SEQ ID NO: 56594 - DNA, 70 bp, Artificial Sequence
  Synthetic
gccaagcatttaggtgacactatagtacaaagtaaaggagaggctgtttcagagctatgctggaaacagc

SEQ ID NO: 56595 - DNA, 70 bp, Artificial Sequence
  Synthetic
gccaagcatttaggtgacactatagtcctaacaagtaatctacacgtttcagagctatgctggaaacagc

SEQ ID NO: 56596 - DNA, 70 bp, Artificial Sequence
  Synthetic
gccaagcatttaggtgacactatagtctcttcgcttttgagatttgtttcagagctatgctggaaacagc

SEQ ID NO: 56597 - DNA, 70 bp, Artificial Sequence
  Synthetic
gccaagcatttaggtgacactatagaaaggaatgaagagggtgtggtttcagagctatgctggaaacagc

SEQ ID NO: 56598 - DNA, 70 bp, Artificial Sequence
  Synthetic
gccaagcatttaggtgacactataggctcggctataacttgctatgtttcagagctatgctggaaacagc

SEQ ID NO: 56599 - DNA, 70 bp, Artificial Sequence
  Synthetic
gccaagcatttaggtgacactatagactcatcagaatgaagacacgtttcagagctatgctggaaacagc

SEQ ID NO: 56600 - DNA, 70 bp, Artificial Sequence
  Synthetic
gccaagcatttaggtgacactatagtgtctcagctctgcctcctcgtttcagagctatgctggaaacagc

SEQ ID NO: 56601 - DNA, 70 bp, Artificial Sequence
  Synthetic
gccaagcatttaggtgacactatagcctcaggccaatttacatttgtttcagagctatgctggaaacagc

SEQ ID NO: 56602 - DNA, 70 bp, Artificial Sequence
  Synthetic
gccaagcatttaggtgacactatagccttgggggccaagaaatgagtttcagagctatgctggaaacagc

SEQ ID NO: 56603 - DNA, 70 bp, Artificial Sequence
  Synthetic
gccaagcatttaggtgacactataggccacagcagggccttttacgtttcagagctatgctggaaacagc

SEQ ID NO: 56604 - DNA, 70 bp, Artificial Sequence
  Synthetic
gccaagcatttaggtgacactatagatttaaggagaagcattgaggtttcagagctatgctggaaacagc

SEQ ID NO: 56605 - DNA, 70 bp, Artificial Sequence
  Synthetic
gccaagcatttaggtgacactatagcagtgtcaggctgcgcactagtttcagagctatgctggaaacagc

SEQ ID NO: 56606 - DNA, 70 bp, Artificial Sequence
  Synthetic
gccaagcatttaggtgacactatagtctggtgccgatcatcttatgtttcagagctatgctggaaacagc

SEQ ID NO: 56607 - DNA, 70 bp, Artificial Sequence
  Synthetic
gccaagcatttaggtgacactatagacacaccatcaacttgtagggtttcagagctatgctggaaacagc

SEQ ID NO: 56608 - DNA, 70 bp, Artificial Sequence
  Synthetic
gccaagcatttaggtgacactatagcattaaggatttgggctgaagtttcagagctatgctggaaacagc

SEQ ID NO: 56609 - DNA, 70 bp, Artificial Sequence
  Synthetic
gccaagcatttaggtgacactatagtacactttgggggatccaaagtttcagagctatgctggaaacagc

SEQ ID NO: 56610 - DNA, 70 bp, Artificial Sequence
  Synthetic
gccaagcatttaggtgacactatagtacaacaggattctaggtgggtttcagagctatgctggaaacagc

SEQ ID NO: 56611 - DNA, 70 bp, Artificial Sequence
  Synthetic
gccaagcatttaggtgacactatagttcacaagcaggtggttgaggtttcagagctatgctggaaacagc

SEQ ID NO: 56612 - DNA, 70 bp, Artificial Sequence
  Synthetic
gccaagcatttaggtgacactatagaacactttgggaaattcagagtttcagagctatgctggaaacagc

SEQ ID NO: 56613 - DNA, 70 bp, Artificial Sequence
  Synthetic
gccaagcatttaggtgacactatagaaagctgacccctgaagaaggtttcagagctatgctggaaacagc

SEQ ID NO: 56614 - DNA, 70 bp, Artificial Sequence
  Synthetic
gccaagcatttaggtgacactataggcctagagctcactagtcacgtttcagagctatgctggaaacagc

SEQ ID NO: 56615 - DNA, 70 bp, Artificial Sequence
  Synthetic
gccaagcatttaggtgacactatagagaagagtgcagaaacacttgtttcagagctatgctggaaacagc

SEQ ID NO: 56616 - DNA, 70 bp, Artificial Sequence
  Synthetic
gccaagcatttaggtgacactatagccaggcaaagtgctgtgaaggtttcagagctatgctggaaacagc

SEQ ID NO: 56617 - DNA, 70 bp, Artificial Sequence
  Synthetic
gccaagcatttaggtgacactatagggtcagtctggaggatgacggtttcagagctatgctggaaacagc

SEQ ID NO: 56618 - DNA, 70 bp, Artificial Sequence
  Synthetic
gccaagcatttaggtgacactataggcctgtcccggaccctgagtgtttcagagctatgctggaaacagc

SEQ ID NO: 56619 - DNA, 70 bp, Artificial Sequence
  Synthetic
gccaagcatttaggtgacactatagtgatggcactaacaactgcggtttcagagctatgctggaaacagc

SEQ ID NO: 56620 - DNA, 70 bp, Artificial Sequence
  Synthetic
gccaagcatttaggtgacactatagttgatgagggcttcactcaggtttcagagctatgctggaaacagc

SEQ ID NO: 56621 - DNA, 70 bp, Artificial Sequence
  Synthetic
gccaagcatttaggtgacactatagcttatacttcttcagtgcccgtttcagagctatgctggaaacagc

SEQ ID NO: 56622 - DNA, 70 bp, Artificial Sequence
  Synthetic
gccaagcatttaggtgacactatagacgttggaaggaatcagaccgtttcagagctatgctggaaacagc

SEQ ID NO: 56623 - DNA, 70 bp, Artificial Sequence
  Synthetic
gccaagcatttaggtgacactatagatgacctcttcagcttctgagtttcagagctatgctggaaacagc

SEQ ID NO: 56624 - DNA, 70 bp, Artificial Sequence
  Synthetic
gccaagcatttaggtgacactatagagaagaggaggatgattattgtttcagagctatgctggaaacagc

SEQ ID NO: 56625 - DNA, 70 bp, Artificial Sequence
  Synthetic
gccaagcatttaggtgacactatagcctggtatgtacatcattccgtttcagagctatgctggaaacagc

SEQ ID NO: 56626 - DNA, 70 bp, Artificial Sequence
  Synthetic
gccaagcatttaggtgacactatagaccattggccttcgatttacgtttcagagctatgctggaaacagc

SEQ ID NO: 56627 - DNA, 70 bp, Artificial Sequence
  Synthetic
gccaagcatttaggtgacactatagatgtaggcagctgtcattctgtttcagagctatgctggaaacagc

SEQ ID NO: 56628 - DNA, 70 bp, Artificial Sequence
  Synthetic
gccaagcatttaggtgacactatagcccaggacctcttctggagagtttcagagctatgctggaaacagc

SEQ ID NO: 56629 - DNA, 70 bp, Artificial Sequence
  Synthetic
gccaagcatttaggtgacactatagctacactaggcgcctatggcgtttcagagctatgctggaaacagc

SEQ ID NO: 56630 - DNA, 70 bp, Artificial Sequence
  Synthetic
gccaagcatttaggtgacactatagatacaccaggcgcctatggcgtttcagagctatgctggaaacagc

SEQ ID NO: 56631 - DNA, 70 bp, Artificial Sequence
  Synthetic
gccaagcatttaggtgacactatagctgccattcttaggagaagggtttcagagctatgctggaaacagc

SEQ ID NO: 56632 - DNA, 70 bp, Artificial Sequence
  Synthetic
gccaagcatttaggtgacactataggaaagctgaacgtgagttaagtttcagagctatgctggaaacagc

SEQ ID NO: 56633 - DNA, 70 bp, Artificial Sequence
  Synthetic
gccaagcatttaggtgacactataggtgcccacagtgcctcactcgtttcagagctatgctggaaacagc

SEQ ID NO: 56634 - DNA, 70 bp, Artificial Sequence
  Synthetic
gccaagcatttaggtgacactatagacagcaagcttcaagcccacgtttcagagctatgctggaaacagc

SEQ ID NO: 56635 - DNA, 70 bp, Artificial Sequence
  Synthetic
gccaagcatttaggtgacactataggtggaaaataagtcgctgttgtttcagagctatgctggaaacagc

SEQ ID NO: 56636 - DNA, 70 bp, Artificial Sequence
  Synthetic
gccaagcatttaggtgacactatagttatcgctctgagtcagagagtttcagagctatgctggaaacagc

SEQ ID NO: 56637 - DNA, 70 bp, Artificial Sequence
  Synthetic
gccaagcatttaggtgacactatagactggcctaaccaattctcagtttcagagctatgctggaaacagc

SEQ ID NO: 56638 - DNA, 70 bp, Artificial Sequence
  Synthetic
gccaagcatttaggtgacactatagtcaaggaactgctggattaagtttcagagctatgctggaaacagc

SEQ ID NO: 56639 - DNA, 70 bp, Artificial Sequence
  Synthetic
gccaagcatttaggtgacactatagccctcaggagtcagtgagtagtttcagagctatgctggaaacagc

SEQ ID NO: 56640 - DNA, 70 bp, Artificial Sequence
  Synthetic
gccaagcatttaggtgacactatagctcctcgctgggtgctcagagtttcagagctatgctggaaacagc

SEQ ID NO: 56641 - DNA, 70 bp, Artificial Sequence
  Synthetic
gccaagcatttaggtgacactatagaggtctgggggtgtcactccgtttcagagctatgctggaaacagc

SEQ ID NO: 56642 - DNA, 70 bp, Artificial Sequence
  Synthetic
gccaagcatttaggtgacactatagatcttctgcttttctctttcgtttcagagctatgctggaaacagc

SEQ ID NO: 56643 - DNA, 70 bp, Artificial Sequence
  Synthetic
gccaagcatttaggtgacactataggtatgtgatcagcgatgaaggtttcagagctatgctggaaacagc

SEQ ID NO: 56644 - DNA, 70 bp, Artificial Sequence
  Synthetic
gccaagcatttaggtgacactataggacctcagccctgggtgctggtttcagagctatgctggaaacagc

SEQ ID NO: 56645 - DNA, 70 bp, Artificial Sequence
  Synthetic
gccaagcatttaggtgacactatagggccacagggtcctctgcatgtttcagagctatgctggaaacagc

SEQ ID NO: 56646 - DNA, 70 bp, Artificial Sequence
  Synthetic
gccaagcatttaggtgacactataggggtggaggttggttgacttgtttcagagctatgctggaaacagc

SEQ ID NO: 56647 - DNA, 70 bp, Artificial Sequence
  Synthetic
gccaagcatttaggtgacactatagaagaattgttcctgggcacagtttcagagctatgctggaaacagc

SEQ ID NO: 56648 - DNA, 70 bp, Artificial Sequence
  Synthetic
gccaagcatttaggtgacactatagtactcagactcataagatcagtttcagagctatgctggaaacagc

SEQ ID NO: 56649 - DNA, 70 bp, Artificial Sequence
  Synthetic
gccaagcatttaggtgacactatagatgattttagctgggagcaggtttcagagctatgctggaaacagc

SEQ ID NO: 56650 - DNA, 70 bp, Artificial Sequence
  Synthetic
gccaagcatttaggtgacactatagaaaaaatcagctgggtgttggtttcagagctatgctggaaacagc

SEQ ID NO: 56651 - DNA, 70 bp, Artificial Sequence
  Synthetic
gccaagcatttaggtgacactatagacgacttcagctggcagcaggtttcagagctatgctggaaacagc

SEQ ID NO: 56652 - DNA, 70 bp, Artificial Sequence
  Synthetic
gccaagcatttaggtgacactatagtagttgtcattgtgcctgaggtttcagagctatgctggaaacagc

SEQ ID NO: 56653 - DNA, 70 bp, Artificial Sequence
  Synthetic
gccaagcatttaggtgacactatagggcagagaaggaggtcgcaggtttcagagctatgctggaaacagc

SEQ ID NO: 56654 - DNA, 70 bp, Artificial Sequence
  Synthetic
gccaagcatttaggtgacactatagaacagcaaggctagttcaaagtttcagagctatgctggaaacagc

SEQ ID NO: 56655 - DNA, 70 bp, Artificial Sequence
  Synthetic
gccaagcatttaggtgacactatagagacgagagagacgaagggtgtttcagagctatgctggaaacagc

SEQ ID NO: 56656 - DNA, 70 bp, Artificial Sequence
  Synthetic
gccaagcatttaggtgacactataggattggccagctgactgctcgtttcagagctatgctggaaacagc

SEQ ID NO: 56657 - DNA, 70 bp, Artificial Sequence
  Synthetic
gccaagcatttaggtgacactatagccaccaactaccttgggacagtttcagagctatgctggaaacagc

SEQ ID NO: 56658 - DNA, 70 bp, Artificial Sequence
  Synthetic
gccaagcatttaggtgacactataggtcgaacttggctgggagaagtttcagagctatgctggaaacagc

SEQ ID NO: 56659 - DNA, 70 bp, Artificial Sequence
  Synthetic
gccaagcatttaggtgacactatagattggagctggtcatactcagtttcagagctatgctggaaacagc

SEQ ID NO: 56660 - DNA, 70 bp, Artificial Sequence
  Synthetic
gccaagcatttaggtgacactatagcgcatgtggctttaaggagtgtttcagagctatgctggaaacagc

SEQ ID NO: 56661 - DNA, 70 bp, Artificial Sequence
  Synthetic
gccaagcatttaggtgacactatagcttcacaggagatcctacatgtttcagagctatgctggaaacagc

SEQ ID NO: 56662 - DNA, 70 bp, Artificial Sequence
  Synthetic
gccaagcatttaggtgacactatagcccgcactgccatcttctaggtttcagagctatgctggaaacagc

SEQ ID NO: 56663 - DNA, 70 bp, Artificial Sequence
  Synthetic
gccaagcatttaggtgacactatagcctcagtttccccacctggagtttcagagctatgctggaaacagc

SEQ ID NO: 56664 - DNA, 70 bp, Artificial Sequence
  Synthetic
gccaagcatttaggtgacactatagggctggctgatttcagtcaagtttcagagctatgctggaaacagc

SEQ ID NO: 56665 - DNA, 70 bp, Artificial Sequence
  Synthetic
gccaagcatttaggtgacactatagctctactgtgtccactcctggtttcagagctatgctggaaacagc

SEQ ID NO: 56666 - DNA, 70 bp, Artificial Sequence
  Synthetic
gccaagcatttaggtgacactatagcagtgtgtgtctgcaattgagtttcagagctatgctggaaacagc

SEQ ID NO: 56667 - DNA, 70 bp, Artificial Sequence
  Synthetic
gccaagcatttaggtgacactataggagtgcttatcagcgattgagtttcagagctatgctggaaacagc

SEQ ID NO: 56668 - DNA, 70 bp, Artificial Sequence
  Synthetic
gccaagcatttaggtgacactatagcagtgcttgtcaacaatggagtttcagagctatgctggaaacagc

SEQ ID NO: 56669 - DNA, 70 bp, Artificial Sequence
  Synthetic
gccaagcatttaggtgacactataggctacctgagcgtaaggggcgtttcagagctatgctggaaacagc

SEQ ID NO: 56670 - DNA, 70 bp, Artificial Sequence
  Synthetic
gccaagcatttaggtgacactatagcacgcttcaatgagaacaacgtttcagagctatgctggaaacagc

SEQ ID NO: 56671 - DNA, 70 bp, Artificial Sequence
  Synthetic
gccaagcatttaggtgacactataggcccctttcagattatatcagtttcagagctatgctggaaacagc

SEQ ID NO: 56672 - DNA, 70 bp, Artificial Sequence
  Synthetic
gccaagcatttaggtgacactatagctcctcaggtgtggactagagtttcagagctatgctggaaacagc

SEQ ID NO: 56673 - DNA, 70 bp, Artificial Sequence
  Synthetic
gccaagcatttaggtgacactatagccccaggaatagattagatcgtttcagagctatgctggaaacagc

SEQ ID NO: 56674 - DNA, 70 bp, Artificial Sequence
  Synthetic
gccaagcatttaggtgacactatagttctgctcagaagatcctcagtttcagagctatgctggaaacagc

SEQ ID NO: 56675 - DNA, 70 bp, Artificial Sequence
  Synthetic
gccaagcatttaggtgacactatagacttactggaagtaaggagcgtttcagagctatgctggaaacagc

SEQ ID NO: 56676 - DNA, 70 bp, Artificial Sequence
  Synthetic
gccaagcatttaggtgacactataggacccatgtgcagacatagggtttcagagctatgctggaaacagc

SEQ ID NO: 56677 - DNA, 70 bp, Artificial Sequence
  Synthetic
gccaagcatttaggtgacactatagttgaatactaccatcgcctggtttcagagctatgctggaaacagc

SEQ ID NO: 56678 - DNA, 70 bp, Artificial Sequence
  Synthetic
gccaagcatttaggtgacactataggacccacgtgcagacatagggtttcagagctatgctggaaacagc

SEQ ID NO: 56679 - DNA, 70 bp, Artificial Sequence
  Synthetic
gccaagcatttaggtgacactatagtggtttaaatcagccaagctgtttcagagctatgctggaaacagc

SEQ ID NO: 56680 - DNA, 70 bp, Artificial Sequence
  Synthetic
gccaagcatttaggtgacactatagaatgttgtcataattccggagtttcagagctatgctggaaacagc

SEQ ID NO: 56681 - DNA, 70 bp, Artificial Sequence
  Synthetic
gccaagcatttaggtgacactataggacacatgtgtgaatgatctgtttcagagctatgctggaaacagc

SEQ ID NO: 56682 - DNA, 70 bp, Artificial Sequence
  Synthetic
gccaagcatttaggtgacactatagaaagaaatctctcctgtcgggtttcagagctatgctggaaacagc

SEQ ID NO: 56683 - DNA, 70 bp, Artificial Sequence
  Synthetic
gccaagcatttaggtgacactatagggtggatctcagtgcctagggtttcagagctatgctggaaacagc

SEQ ID NO: 56684 - DNA, 70 bp, Artificial Sequence
  Synthetic
gccaagcatttaggtgacactataggttggtggtctcaggcactggtttcagagctatgctggaaacagc

SEQ ID NO: 56685 - DNA, 70 bp, Artificial Sequence
  Synthetic
gccaagcatttaggtgacactatagcagctcttcagtagtgaccagtttcagagctatgctggaaacagc

SEQ ID NO: 56686 - DNA, 70 bp, Artificial Sequence
  Synthetic
gccaagcatttaggtgacactatagttgtaagcatagcgcaccaagtttcagagctatgctggaaacagc

SEQ ID NO: 56687 - DNA, 70 bp, Artificial Sequence
  Synthetic
gccaagcatttaggtgacactatagacatgggacaaatgccacaggtttcagagctatgctggaaacagc

SEQ ID NO: 56688 - DNA, 70 bp, Artificial Sequence
  Synthetic
gccaagcatttaggtgacactatagtatttacacgtgtgaagcaagtttcagagctatgctggaaacagc

SEQ ID NO: 56689 - DNA, 70 bp, Artificial Sequence
  Synthetic
gccaagcatttaggtgacactatagactgggaaaaaatggttggcgtttcagagctatgctggaaacagc

SEQ ID NO: 56690 - DNA, 70 bp, Artificial Sequence
  Synthetic
gccaagcatttaggtgacactatagtgccatgaagaaatatgagtgtttcagagctatgctggaaacagc

SEQ ID NO: 56691 - DNA, 70 bp, Artificial Sequence
  Synthetic
gccaagcatttaggtgacactataggctgcggggagggtctttaggtttcagagctatgctggaaacagc

SEQ ID NO: 56692 - DNA, 70 bp, Artificial Sequence
  Synthetic
gccaagcatttaggtgacactatagctgtgtagcgagtcttgtctgtttcagagctatgctggaaacagc

SEQ ID NO: 56693 - DNA, 70 bp, Artificial Sequence
  Synthetic
gccaagcatttaggtgacactatagctttcaaagctcaaggtttggtttcagagctatgctggaaacagc

SEQ ID NO: 56694 - DNA, 70 bp, Artificial Sequence
  Synthetic
gccaagcatttaggtgacactatagctgatctgcctcctttagttgtttcagagctatgctggaaacagc

SEQ ID NO: 56695 - DNA, 70 bp, Artificial Sequence
  Synthetic
gccaagcatttaggtgacactatagcttgatggcagaggaactgagtttcagagctatgctggaaacagc

SEQ ID NO: 56696 - DNA, 70 bp, Artificial Sequence
  Synthetic
gccaagcatttaggtgacactatagtcactcacagggaccctgaagtttcagagctatgctggaaacagc

SEQ ID NO: 56697 - DNA, 70 bp, Artificial Sequence
  Synthetic
gccaagcatttaggtgacactatagcctgacgactacaaggcagagtttcagagctatgctggaaacagc

SEQ ID NO: 56698 - DNA, 70 bp, Artificial Sequence
  Synthetic
gccaagcatttaggtgacactatagaagcactacccatactgagagtttcagagctatgctggaaacagc

SEQ ID NO: 56699 - DNA, 70 bp, Artificial Sequence
  Synthetic
gccaagcatttaggtgacactatagtgccctgcaagcgataggaggtttcagagctatgctggaaacagc

SEQ ID NO: 56700 - DNA, 70 bp, Artificial Sequence
  Synthetic
gccaagcatttaggtgacactatagtgcagcacgccgacaagtgagtttcagagctatgctggaaacagc

SEQ ID NO: 56701 - DNA, 70 bp, Artificial Sequence
  Synthetic
gccaagcatttaggtgacactatagttccggatggtgctcgtcacgtttcagagctatgctggaaacagc

SEQ ID NO: 56702 - DNA, 70 bp, Artificial Sequence
  Synthetic
gccaagcatttaggtgacactataggaggcggccgtgtggtagcggtttcagagctatgctggaaacagc

SEQ ID NO: 56703 - DNA, 70 bp, Artificial Sequence
  Synthetic
gccaagcatttaggtgacactataggggttgcgagtcattagaaagtttcagagctatgctggaaacagc

SEQ ID NO: 56704 - DNA, 70 bp, Artificial Sequence
  Synthetic
gccaagcatttaggtgacactataggcctgggtcagaactgagcggtttcagagctatgctggaaacagc

SEQ ID NO: 56705 - DNA, 70 bp, Artificial Sequence
  Synthetic
gccaagcatttaggtgacactataggggaggagagaagtttaaaagtttcagagctatgctggaaacagc

SEQ ID NO: 56706 - DNA, 70 bp, Artificial Sequence
  Synthetic
gccaagcatttaggtgacactatagaacgaagccgccgtgtggtagtttcagagctatgctggaaacagc

SEQ ID NO: 56707 - DNA, 70 bp, Artificial Sequence
  Synthetic
gccaagcatttaggtgacactataggcttggacactggatctcaggtttcagagctatgctggaaacagc

SEQ ID NO: 56708 - DNA, 70 bp, Artificial Sequence
  Synthetic
gccaagcatttaggtgacactatagggcagcgttagtactgaaaagtttcagagctatgctggaaacagc

SEQ ID NO: 56709 - DNA, 70 bp, Artificial Sequence
  Synthetic
gccaagcatttaggtgacactatagttggcagttgtgtcattgaagtttcagagctatgctggaaacagc

SEQ ID NO: 56710 - DNA, 70 bp, Artificial Sequence
  Synthetic
gccaagcatttaggtgacactatagttgttaaggtagtttgtgaggtttcagagctatgctggaaacagc

SEQ ID NO: 56711 - DNA, 70 bp, Artificial Sequence
  Synthetic
gccaagcatttaggtgacactatagccacagccacgatcatggtagtttcagagctatgctggaaacagc

SEQ ID NO: 56712 - DNA, 70 bp, Artificial Sequence
  Synthetic
gccaagcatttaggtgacactatagaggtcttgttgaagttttaggtttcagagctatgctggaaacagc

SEQ ID NO: 56713 - DNA, 70 bp, Artificial Sequence
  Synthetic
gccaagcatttaggtgacactataggccaacaaggcgtcaccttagtttcagagctatgctggaaacagc

SEQ ID NO: 56714 - DNA, 70 bp, Artificial Sequence
  Synthetic
gccaagcatttaggtgacactatagtttctagactaaagccataggtttcagagctatgctggaaacagc

SEQ ID NO: 56715 - DNA, 70 bp, Artificial Sequence
  Synthetic
gccaagcatttaggtgacactatagggcagagctgtttcacgcaagtttcagagctatgctggaaacagc

SEQ ID NO: 56716 - DNA, 70 bp, Artificial Sequence
  Synthetic
gccaagcatttaggtgacactataggttggcccaggccttctagcgtttcagagctatgctggaaacagc

SEQ ID NO: 56717 - DNA, 70 bp, Artificial Sequence
  Synthetic
gccaagcatttaggtgacactatagcggtgacactgttaatcgttgtttcagagctatgctggaaacagc

SEQ ID NO: 56718 - DNA, 70 bp, Artificial Sequence
  Synthetic
gccaagcatttaggtgacactatagtaggagggcgagggcttagtgtttcagagctatgctggaaacagc

SEQ ID NO: 56719 - DNA, 70 bp, Artificial Sequence
  Synthetic
gccaagcatttaggtgacactataggaagaactgtgccagcaggcgtttcagagctatgctggaaacagc

SEQ ID NO: 56720 - DNA, 70 bp, Artificial Sequence
  Synthetic
gccaagcatttaggtgacactataggggaagacagcaaacctagcgtttcagagctatgctggaaacagc

SEQ ID NO: 56721 - DNA, 70 bp, Artificial Sequence
  Synthetic
gccaagcatttaggtgacactatagagtagtttcttgtttagctggtttcagagctatgctggaaacagc

SEQ ID NO: 56722 - DNA, 70 bp, Artificial Sequence
  Synthetic
gccaagcatttaggtgacactatagacctcccggctgcatctcaggtttcagagctatgctggaaacagc

SEQ ID NO: 56723 - DNA, 70 bp, Artificial Sequence
  Synthetic
gccaagcatttaggtgacactataggattccaaggctggtgagtggtttcagagctatgctggaaacagc

SEQ ID NO: 56724 - DNA, 70 bp, Artificial Sequence
  Synthetic
gccaagcatttaggtgacactatagcctctctgctgttcacctccgtttcagagctatgctggaaacagc

SEQ ID NO: 56725 - DNA, 70 bp, Artificial Sequence
  Synthetic
gccaagcatttaggtgacactatagcctggaggcctctgtgctcagtttcagagctatgctggaaacagc

SEQ ID NO: 56726 - DNA, 70 bp, Artificial Sequence
  Synthetic
gccaagcatttaggtgacactataggactccaaggctggtgagtggtttcagagctatgctggaaacagc

SEQ ID NO: 56727 - DNA, 70 bp, Artificial Sequence
  Synthetic
gccaagcatttaggtgacactataggatcatcagatctgttcccagtttcagagctatgctggaaacagc

SEQ ID NO: 56728 - DNA, 70 bp, Artificial Sequence
  Synthetic
gccaagcatttaggtgacactatagccctttttgtctttcttagcgtttcagagctatgctggaaacagc

SEQ ID NO: 56729 - DNA, 70 bp, Artificial Sequence
  Synthetic
gccaagcatttaggtgacactataggcccccaagctgcagctggagtttcagagctatgctggaaacagc

SEQ ID NO: 56730 - DNA, 70 bp, Artificial Sequence
  Synthetic
gccaagcatttaggtgacactatagacccccaagatgcagccggggtttcagagctatgctggaaacagc

SEQ ID NO: 56731 - DNA, 70 bp, Artificial Sequence
  Synthetic
gccaagcatttaggtgacactatagtccccagagtggtgagtgacgtttcagagctatgctggaaacagc

SEQ ID NO: 56732 - DNA, 70 bp, Artificial Sequence
  Synthetic
gccaagcatttaggtgacactatagtgcgtccccccctgggctaggtttcagagctatgctggaaacagc

SEQ ID NO: 56733 - DNA, 70 bp, Artificial Sequence
  Synthetic
gccaagcatttaggtgacactatagaccctggccatccactagccgtttcagagctatgctggaaacagc

SEQ ID NO: 56734 - DNA, 70 bp, Artificial Sequence
  Synthetic
gccaagcatttaggtgacactatagcagcccagctgccgacgcccgtttcagagctatgctggaaacagc

SEQ ID NO: 56735 - DNA, 70 bp, Artificial Sequence
  Synthetic
gccaagcatttaggtgacactatagtccccaaagtggtgagtgaggtttcagagctatgctggaaacagc

SEQ ID NO: 56736 - DNA, 70 bp, Artificial Sequence
  Synthetic
gccaagcatttaggtgacactatagactctggccatccactagccgtttcagagctatgctggaaacagc

SEQ ID NO: 56737 - DNA, 70 bp, Artificial Sequence
  Synthetic
gccaagcatttaggtgacactatagcccccacagtggtgagtgaggtttcagagctatgctggaaacagc

SEQ ID NO: 56738 - DNA, 70 bp, Artificial Sequence
  Synthetic
gccaagcatttaggtgacactatagctgggtcccccctggattaggtttcagagctatgctggaaacagc

SEQ ID NO: 56739 - DNA, 70 bp, Artificial Sequence
  Synthetic
gccaagcatttaggtgacactatagctgggtcccccgtgggctaggtttcagagctatgctggaaacagc

SEQ ID NO: 56740 - DNA, 70 bp, Artificial Sequence
  Synthetic
gccaagcatttaggtgacactatagggggacacatttgggctcaggtttcagagctatgctggaaacagc

SEQ ID NO: 56741 - DNA, 70 bp, Artificial Sequence
  Synthetic
gccaagcatttaggtgacactatagtcggtattatgatgaggatggtttcagagctatgctggaaacagc

SEQ ID NO: 56742 - DNA, 70 bp, Artificial Sequence
  Synthetic
gccaagcatttaggtgacactatagcagcctacaacattgtgacagtttcagagctatgctggaaacagc

SEQ ID NO: 56743 - DNA, 70 bp, Artificial Sequence
  Synthetic
gccaagcatttaggtgacactatagcaagtggctctggctagaaggtttcagagctatgctggaaacagc

SEQ ID NO: 56744 - DNA, 70 bp, Artificial Sequence
  Synthetic
gccaagcatttaggtgacactatagggagccctcccatttctcaagtttcagagctatgctggaaacagc

SEQ ID NO: 56745 - DNA, 70 bp, Artificial Sequence
  Synthetic
gccaagcatttaggtgacactataggccacagcaggggaagactggtttcagagctatgctggaaacagc

SEQ ID NO: 56746 - DNA, 70 bp, Artificial Sequence
  Synthetic
gccaagcatttaggtgacactatagggtccttgagtgttcagggcgtttcagagctatgctggaaacagc

SEQ ID NO: 56747 - DNA, 70 bp, Artificial Sequence
  Synthetic
gccaagcatttaggtgacactatagctgagtggccctggctcagtgtttcagagctatgctggaaacagc

SEQ ID NO: 56748 - DNA, 70 bp, Artificial Sequence
  Synthetic
gccaagcatttaggtgacactataggcacaccccagaagaagtgagtttcagagctatgctggaaacagc

SEQ ID NO: 56749 - DNA, 70 bp, Artificial Sequence
  Synthetic
gccaagcatttaggtgacactataggggctgggccagggctaggggtttcagagctatgctggaaacagc

SEQ ID NO: 56750 - DNA, 70 bp, Artificial Sequence
  Synthetic
gccaagcatttaggtgacactatagaggaacttatttccttcctagtttcagagctatgctggaaacagc

SEQ ID NO: 56751 - DNA, 70 bp, Artificial Sequence
  Synthetic
gccaagcatttaggtgacactatagcagacctcaactctgcctgagtttcagagctatgctggaaacagc

SEQ ID NO: 56752 - DNA, 70 bp, Artificial Sequence
  Synthetic
gccaagcatttaggtgacactatagcccagaaggactcttctatggtttcagagctatgctggaaacagc

SEQ ID NO: 56753 - DNA, 70 bp, Artificial Sequence
  Synthetic
gccaagcatttaggtgacactataggtggctcaattctgtgcctcgtttcagagctatgctggaaacagc

SEQ ID NO: 56754 - DNA, 70 bp, Artificial Sequence
  Synthetic
gccaagcatttaggtgacactatagaggggccttcagttcaaaaagtttcagagctatgctggaaacagc

SEQ ID NO: 56755 - DNA, 70 bp, Artificial Sequence
  Synthetic
gccaagcatttaggtgacactataggtcgttcgtacatctctcgtgtttcagagctatgctggaaacagc

SEQ ID NO: 56756 - DNA, 70 bp, Artificial Sequence
  Synthetic
gccaagcatttaggtgacactatagcgcaagcagctgctacttctgtttcagagctatgctggaaacagc

SEQ ID NO: 56757 - DNA, 70 bp, Artificial Sequence
  Synthetic
gccaagcatttaggtgacactataggtgcaagagttagcaattcagtttcagagctatgctggaaacagc

SEQ ID NO: 56758 - DNA, 70 bp, Artificial Sequence
  Synthetic
gccaagcatttaggtgacactatagacaacaaaaccacatgtcatgtttcagagctatgctggaaacagc

SEQ ID NO: 56759 - DNA, 70 bp, Artificial Sequence
  Synthetic
gccaagcatttaggtgacactataggtttcaacctcgagactccagtttcagagctatgctggaaacagc

SEQ ID NO: 56760 - DNA, 70 bp, Artificial Sequence
  Synthetic
gccaagcatttaggtgacactatagaaatgagatcagcaaaacgcgtttcagagctatgctggaaacagc

SEQ ID NO: 56761 - DNA, 70 bp, Artificial Sequence
  Synthetic
gccaagcatttaggtgacactatagaatctttactcagtctctgtgtttcagagctatgctggaaacagc

SEQ ID NO: 56762 - DNA, 70 bp, Artificial Sequence
  Synthetic
gccaagcatttaggtgacactataggtcactcacaaaccacaaaggtttcagagctatgctggaaacagc

SEQ ID NO: 56763 - DNA, 70 bp, Artificial Sequence
  Synthetic
gccaagcatttaggtgacactatagaggccaaagccggaggagtggtttcagagctatgctggaaacagc

SEQ ID NO: 56764 - DNA, 70 bp, Artificial Sequence
  Synthetic
gccaagcatttaggtgacactatagttcatcctggctttagggaggtttcagagctatgctggaaacagc

SEQ ID NO: 56765 - DNA, 70 bp, Artificial Sequence
  Synthetic
gccaagcatttaggtgacactatagccacgacctggcttagacacgtttcagagctatgctggaaacagc

SEQ ID NO: 56766 - DNA, 70 bp, Artificial Sequence
  Synthetic
gccaagcatttaggtgacactatagtaactgtagtcccagctactgtttcagagctatgctggaaacagc

SEQ ID NO: 56767 - DNA, 70 bp, Artificial Sequence
  Synthetic
gccaagcatttaggtgacactatagctgtttacatctgtgagaaggtttcagagctatgctggaaacagc

SEQ ID NO: 56768 - DNA, 70 bp, Artificial Sequence
  Synthetic
gccaagcatttaggtgacactatagagttggactactgtcccgacgtttcagagctatgctggaaacagc

SEQ ID NO: 56769 - DNA, 70 bp, Artificial Sequence
  Synthetic
gccaagcatttaggtgacactatagagctgtggctggggggatgagtttcagagctatgctggaaacagc

SEQ ID NO: 56770 - DNA, 70 bp, Artificial Sequence
  Synthetic
gccaagcatttaggtgacactatagtcatcttcatgttgaacttggtttcagagctatgctggaaacagc

SEQ ID NO: 56771 - DNA, 70 bp, Artificial Sequence
  Synthetic
gccaagcatttaggtgacactatagcattttcatgttgaacctccgtttcagagctatgctggaaacagc

SEQ ID NO: 56772 - DNA, 70 bp, Artificial Sequence
  Synthetic
gccaagcatttaggtgacactatagcaacatgaagatgatctgaggtttcagagctatgctggaaacagc

SEQ ID NO: 56773 - DNA, 70 bp, Artificial Sequence
  Synthetic
gccaagcatttaggtgacactatagaaggaaaggtcagaagagctgtttcagagctatgctggaaacagc

SEQ ID NO: 56774 - DNA, 70 bp, Artificial Sequence
  Synthetic
gccaagcatttaggtgacactatagaacaacttcaaaagtgcagtgtttcagagctatgctggaaacagc

SEQ ID NO: 56775 - DNA, 70 bp, Artificial Sequence
  Synthetic
gccaagcatttaggtgacactatagggggcctggatgccccttgggtttcagagctatgctggaaacagc

SEQ ID NO: 56776 - DNA, 70 bp, Artificial Sequence
  Synthetic
gccaagcatttaggtgacactatagacgaagattttttcctgggtgtttcagagctatgctggaaacagc

SEQ ID NO: 56777 - DNA, 70 bp, Artificial Sequence
  Synthetic
gccaagcatttaggtgacactataggggtagacgggggctgcggggtttcagagctatgctggaaacagc

SEQ ID NO: 56778 - DNA, 70 bp, Artificial Sequence
  Synthetic
gccaagcatttaggtgacactatagcttggactttatctgggcaagtttcagagctatgctggaaacagc

SEQ ID NO: 56779 - DNA, 70 bp, Artificial Sequence
  Synthetic
gccaagcatttaggtgacactatagccactgtggagcttccctgagtttcagagctatgctggaaacagc

SEQ ID NO: 56780 - DNA, 70 bp, Artificial Sequence
  Synthetic
gccaagcatttaggtgacactatagaacagttacaactgcaactcgtttcagagctatgctggaaacagc

SEQ ID NO: 56781 - DNA, 70 bp, Artificial Sequence
  Synthetic
gccaagcatttaggtgacactatagaaggcatcttatgtgttcttgtttcagagctatgctggaaacagc

SEQ ID NO: 56782 - DNA, 70 bp, Artificial Sequence
  Synthetic
gccaagcatttaggtgacactatagtcacaagcaagtgcatttgagtttcagagctatgctggaaacagc

SEQ ID NO: 56783 - DNA, 70 bp, Artificial Sequence
  Synthetic
gccaagcatttaggtgacactataggtggcaactgcaatttggaagtttcagagctatgctggaaacagc

SEQ ID NO: 56784 - DNA, 70 bp, Artificial Sequence
  Synthetic
gccaagcatttaggtgacactatagaggtcttggtaaatttcctggtttcagagctatgctggaaacagc

SEQ ID NO: 56785 - DNA, 70 bp, Artificial Sequence
  Synthetic
gccaagcatttaggtgacactataggtgtcagatgcttcacaatagtttcagagctatgctggaaacagc

SEQ ID NO: 56786 - DNA, 70 bp, Artificial Sequence
  Synthetic
gccaagcatttaggtgacactatagatttcactgtacatccgttggtttcagagctatgctggaaacagc

SEQ ID NO: 56787 - DNA, 70 bp, Artificial Sequence
  Synthetic
gccaagcatttaggtgacactatagctgtttagtttgtggtcttggtttcagagctatgctggaaacagc

SEQ ID NO: 56788 - DNA, 70 bp, Artificial Sequence
  Synthetic
gccaagcatttaggtgacactatagccctgtggactggttgggacgtttcagagctatgctggaaacagc

SEQ ID NO: 56789 - DNA, 70 bp, Artificial Sequence
  Synthetic
gccaagcatttaggtgacactatagtgttatgagtactcttcagtgtttcagagctatgctggaaacagc

SEQ ID NO: 56790 - DNA, 70 bp, Artificial Sequence
  Synthetic
gccaagcatttaggtgacactatagaggtactcaggaggctgagcgtttcagagctatgctggaaacagc

SEQ ID NO: 56791 - DNA, 70 bp, Artificial Sequence
  Synthetic
gccaagcatttaggtgacactataggggcacctacaagcgtttgtgtttcagagctatgctggaaacagc

SEQ ID NO: 56792 - DNA, 70 bp, Artificial Sequence
  Synthetic
gccaagcatttaggtgacactatagctgtgtggctatcactagcagtttcagagctatgctggaaacagc

SEQ ID NO: 56793 - DNA, 70 bp, Artificial Sequence
  Synthetic
gccaagcatttaggtgacactatagtatgcattcttccaactgctgtttcagagctatgctggaaacagc

SEQ ID NO: 56794 - DNA, 70 bp, Artificial Sequence
  Synthetic
gccaagcatttaggtgacactataggcaccatcttcccgcggtgagtttcagagctatgctggaaacagc

SEQ ID NO: 56795 - DNA, 70 bp, Artificial Sequence
  Synthetic
gccaagcatttaggtgacactatagtataactttatgtgggaggcgtttcagagctatgctggaaacagc

SEQ ID NO: 56796 - DNA, 70 bp, Artificial Sequence
  Synthetic
gccaagcatttaggtgacactataggagtgagcatgaagcagagtgtttcagagctatgctggaaacagc

SEQ ID NO: 56797 - DNA, 70 bp, Artificial Sequence
  Synthetic
gccaagcatttaggtgacactatagtgtgccatcctgatcaaatggtttcagagctatgctggaaacagc

SEQ ID NO: 56798 - DNA, 70 bp, Artificial Sequence
  Synthetic
gccaagcatttaggtgacactatagatgcctcccacacctaacccgtttcagagctatgctggaaacagc

SEQ ID NO: 56799 - DNA, 70 bp, Artificial Sequence
  Synthetic
gccaagcatttaggtgacactataggggtgcagcctcagcaatgggtttcagagctatgctggaaacagc

SEQ ID NO: 56800 - DNA, 70 bp, Artificial Sequence
  Synthetic
gccaagcatttaggtgacactatagtgtgtgctcatcgcgcagccgtttcagagctatgctggaaacagc

SEQ ID NO: 56801 - DNA, 70 bp, Artificial Sequence
  Synthetic
gccaagcatttaggtgacactatagcaaggttttaagagtctaccgtttcagagctatgctggaaacagc

SEQ ID NO: 56802 - DNA, 70 bp, Artificial Sequence
  Synthetic
gccaagcatttaggtgacactatagtggaccgtagacaaacatgagtttcagagctatgctggaaacagc

SEQ ID NO: 56803 - DNA, 70 bp, Artificial Sequence
  Synthetic
gccaagcatttaggtgacactatagggctctgaggtgggtcaggcgtttcagagctatgctggaaacagc

SEQ ID NO: 56804 - DNA, 70 bp, Artificial Sequence
  Synthetic
gccaagcatttaggtgacactataggaacaagcgcttctactgaggtttcagagctatgctggaaacagc

SEQ ID NO: 56805 - DNA, 70 bp, Artificial Sequence
  Synthetic
gccaagcatttaggtgacactataggggctcagtagaagcgctttgtttcagagctatgctggaaacagc

SEQ ID NO: 56806 - DNA, 70 bp, Artificial Sequence
  Synthetic
gccaagcatttaggtgacactatagcagccaagccttctgtaaatgtttcagagctatgctggaaacagc

SEQ ID NO: 56807 - DNA, 70 bp, Artificial Sequence
  Synthetic
gccaagcatttaggtgacactatagcacccccagctggaggtcacgtttcagagctatgctggaaacagc

SEQ ID NO: 56808 - DNA, 70 bp, Artificial Sequence
  Synthetic
gccaagcatttaggtgacactatagctgtcaagcagaatagacaggtttcagagctatgctggaaacagc

SEQ ID NO: 56809 - DNA, 70 bp, Artificial Sequence
  Synthetic
gccaagcatttaggtgacactatagatcgagagatatcgtccaccgtttcagagctatgctggaaacagc

SEQ ID NO: 56810 - DNA, 70 bp, Artificial Sequence
  Synthetic
gccaagcatttaggtgacactatagcaagtccaaacgctcctgaagtttcagagctatgctggaaacagc

SEQ ID NO: 56811 - DNA, 70 bp, Artificial Sequence
  Synthetic
gccaagcatttaggtgacactatagttaatgggttatcacacgaggtttcagagctatgctggaaacagc

SEQ ID NO: 56812 - DNA, 70 bp, Artificial Sequence
  Synthetic
gccaagcatttaggtgacactatagtagacgtgcaccagaaataagtttcagagctatgctggaaacagc

SEQ ID NO: 56813 - DNA, 70 bp, Artificial Sequence
  Synthetic
gccaagcatttaggtgacactatagtatttctggtgcacgtctaggtttcagagctatgctggaaacagc

SEQ ID NO: 56814 - DNA, 70 bp, Artificial Sequence
  Synthetic
gccaagcatttaggtgacactatagaacacagctacttctttcgcgtttcagagctatgctggaaacagc

SEQ ID NO: 56815 - DNA, 70 bp, Artificial Sequence
  Synthetic
gccaagcatttaggtgacactatagtcttctgtgtatatggcactgtttcagagctatgctggaaacagc

SEQ ID NO: 56816 - DNA, 70 bp, Artificial Sequence
  Synthetic
gccaagcatttaggtgacactatagaactgcagcatcatgtaatcgtttcagagctatgctggaaacagc

SEQ ID NO: 56817 - DNA, 70 bp, Artificial Sequence
  Synthetic
gccaagcatttaggtgacactatagcagtgcaggctcggcctcaggtttcagagctatgctggaaacagc

SEQ ID NO: 56818 - DNA, 70 bp, Artificial Sequence
  Synthetic
gccaagcatttaggtgacactatagccagggtctaaagctagggagtttcagagctatgctggaaacagc

SEQ ID NO: 56819 - DNA, 70 bp, Artificial Sequence
  Synthetic
gccaagcatttaggtgacactatagcagcttctattggatgctctgtttcagagctatgctggaaacagc

SEQ ID NO: 56820 - DNA, 70 bp, Artificial Sequence
  Synthetic
gccaagcatttaggtgacactatagcatcacgtagcagcctcttggtttcagagctatgctggaaacagc

SEQ ID NO: 56821 - DNA, 70 bp, Artificial Sequence
  Synthetic
gccaagcatttaggtgacactatagaccagacctaatcgagcctcgtttcagagctatgctggaaacagc

SEQ ID NO: 56822 - DNA, 70 bp, Artificial Sequence
  Synthetic
gccaagcatttaggtgacactatagacacctgccgcggcgcctaggtttcagagctatgctggaaacagc

SEQ ID NO: 56823 - DNA, 70 bp, Artificial Sequence
  Synthetic
gccaagcatttaggtgacactataggcgccgggcgttactgaactgtttcagagctatgctggaaacagc

SEQ ID NO: 56824 - DNA, 70 bp, Artificial Sequence
  Synthetic
gccaagcatttaggtgacactatagacgagtggactaagatcaatgtttcagagctatgctggaaacagc

SEQ ID NO: 56825 - DNA, 70 bp, Artificial Sequence
  Synthetic
gccaagcatttaggtgacactatagtgttgatagatcagcgaaccgtttcagagctatgctggaaacagc

SEQ ID NO: 56826 - DNA, 70 bp, Artificial Sequence
  Synthetic
gccaagcatttaggtgacactatagtccactactgccagaccagagtttcagagctatgctggaaacagc

SEQ ID NO: 56827 - DNA, 70 bp, Artificial Sequence
  Synthetic
gccaagcatttaggtgacactataggtatggaggcttacatcacagtttcagagctatgctggaaacagc

SEQ ID NO: 56828 - DNA, 70 bp, Artificial Sequence
  Synthetic
gccaagcatttaggtgacactataggttgcagatagaagaagagggtttcagagctatgctggaaacagc

SEQ ID NO: 56829 - DNA, 70 bp, Artificial Sequence
  Synthetic
gccaagcatttaggtgacactatagagctggtaaaatgagaagttgtttcagagctatgctggaaacagc

SEQ ID NO: 56830 - DNA, 70 bp, Artificial Sequence
  Synthetic
gccaagcatttaggtgacactatagagtgcccaaactgcttcagtgtttcagagctatgctggaaacagc

SEQ ID NO: 56831 - DNA, 70 bp, Artificial Sequence
  Synthetic
gccaagcatttaggtgacactatagtgtttttatcgcagggcttcgtttcagagctatgctggaaacagc

SEQ ID NO: 56832 - DNA, 70 bp, Artificial Sequence
  Synthetic
gccaagcatttaggtgacactataggccaaaagaactggcgtaaggtttcagagctatgctggaaacagc

SEQ ID NO: 56833 - DNA, 70 bp, Artificial Sequence
  Synthetic
gccaagcatttaggtgacactatagagacggagaaaaggactagggtttcagagctatgctggaaacagc

SEQ ID NO: 56834 - DNA, 70 bp, Artificial Sequence
  Synthetic
gccaagcatttaggtgacactatagttcggggaatcaattctccagtttcagagctatgctggaaacagc

SEQ ID NO: 56835 - DNA, 70 bp, Artificial Sequence
  Synthetic
gccaagcatttaggtgacactatagtgtgaagtaagaattctgcagtttcagagctatgctggaaacagc

SEQ ID NO: 56836 - DNA, 70 bp, Artificial Sequence
  Synthetic
gccaagcatttaggtgacactataggcgcctggctggctctcagggtttcagagctatgctggaaacagc

SEQ ID NO: 56837 - DNA, 70 bp, Artificial Sequence
  Synthetic
gccaagcatttaggtgacactataggcagaagcagagtattattcgtttcagagctatgctggaaacagc

SEQ ID NO: 56838 - DNA, 70 bp, Artificial Sequence
  Synthetic
gccaagcatttaggtgacactatagacctcaaaagtctcacatgggtttcagagctatgctggaaacagc

SEQ ID NO: 56839 - DNA, 70 bp, Artificial Sequence
  Synthetic
gccaagcatttaggtgacactatagactaagtggagaatctttgagtttcagagctatgctggaaacagc

SEQ ID NO: 56840 - DNA, 70 bp, Artificial Sequence
  Synthetic
gccaagcatttaggtgacactatagctaactattgtttcttggccgtttcagagctatgctggaaacagc

SEQ ID NO: 56841 - DNA, 70 bp, Artificial Sequence
  Synthetic
gccaagcatttaggtgacactatagaaaatctatacaaggctgccgtttcagagctatgctggaaacagc

SEQ ID NO: 56842 - DNA, 70 bp, Artificial Sequence
  Synthetic
gccaagcatttaggtgacactatagtggcttctctcttcactgaagtttcagagctatgctggaaacagc

SEQ ID NO: 56843 - DNA, 70 bp, Artificial Sequence
  Synthetic
gccaagcatttaggtgacactatagctaccccagcttatggctacgtttcagagctatgctggaaacagc

SEQ ID NO: 56844 - DNA, 70 bp, Artificial Sequence
  Synthetic
gccaagcatttaggtgacactatagagacggcagggcaggtgtgggtttcagagctatgctggaaacagc

SEQ ID NO: 56845 - DNA, 70 bp, Artificial Sequence
  Synthetic
gccaagcatttaggtgacactatagtgcagtcactcaacaaacaagtttcagagctatgctggaaacagc

SEQ ID NO: 56846 - DNA, 70 bp, Artificial Sequence
  Synthetic
gccaagcatttaggtgacactatagagggcaatggcaagcaatctgtttcagagctatgctggaaacagc

SEQ ID NO: 56847 - DNA, 70 bp, Artificial Sequence
  Synthetic
gccaagcatttaggtgacactatagtggtggccgtttgttagtgcgtttcagagctatgctggaaacagc

SEQ ID NO: 56848 - DNA, 70 bp, Artificial Sequence
  Synthetic
gccaagcatttaggtgacactatagggagaaaaagatcgatgagagtttcagagctatgctggaaacagc

SEQ ID NO: 56849 - DNA, 70 bp, Artificial Sequence
  Synthetic
gccaagcatttaggtgacactatagcttacgcaaatttctgcaacgtttcagagctatgctggaaacagc

SEQ ID NO: 56850 - DNA, 70 bp, Artificial Sequence
  Synthetic
gccaagcatttaggtgacactatagcctgcttctcccactcctgagtttcagagctatgctggaaacagc

SEQ ID NO: 56851 - DNA, 70 bp, Artificial Sequence
  Synthetic
gccaagcatttaggtgacactatagcagaacttcaaagaccaccagtttcagagctatgctggaaacagc

SEQ ID NO: 56852 - DNA, 70 bp, Artificial Sequence
  Synthetic
gccaagcatttaggtgacactatagtttatctctttcctctgctagtttcagagctatgctggaaacagc

SEQ ID NO: 56853 - DNA, 70 bp, Artificial Sequence
  Synthetic
gccaagcatttaggtgacactatagaagagacggcagggcaggtggtttcagagctatgctggaaacagc

SEQ ID NO: 56854 - DNA, 70 bp, Artificial Sequence
  Synthetic
gccaagcatttaggtgacactatagctgaccccacagaagcttgcgtttcagagctatgctggaaacagc

SEQ ID NO: 56855 - DNA, 70 bp, Artificial Sequence
  Synthetic
gccaagcatttaggtgacactatagtctgggttccgggatctgaagtttcagagctatgctggaaacagc

SEQ ID NO: 56856 - DNA, 70 bp, Artificial Sequence
  Synthetic
gccaagcatttaggtgacactatagggtgataatcagctcagctcgtttcagagctatgctggaaacagc

SEQ ID NO: 56857 - DNA, 70 bp, Artificial Sequence
  Synthetic
gccaagcatttaggtgacactataggacgaaccctccatctgggggtttcagagctatgctggaaacagc

SEQ ID NO: 56858 - DNA, 70 bp, Artificial Sequence
  Synthetic
gccaagcatttaggtgacactatagagaagcatcagaagcagttggtttcagagctatgctggaaacagc

SEQ ID NO: 56859 - DNA, 70 bp, Artificial Sequence
  Synthetic
gccaagcatttaggtgacactatagaaaacatcagaaccagctaagtttcagagctatgctggaaacagc

SEQ ID NO: 56860 - DNA, 70 bp, Artificial Sequence
  Synthetic
gccaagcatttaggtgacactataggagtggtacatcgtcatagcgtttcagagctatgctggaaacagc

SEQ ID NO: 56861 - DNA, 70 bp, Artificial Sequence
  Synthetic
gccaagcatttaggtgacactataggacgggaacccacgtctggcgtttcagagctatgctggaaacagc

SEQ ID NO: 56862 - DNA, 70 bp, Artificial Sequence
  Synthetic
gccaagcatttaggtgacactatagagagagaaaagggctttactgtttcagagctatgctggaaacagc

SEQ ID NO: 56863 - DNA, 70 bp, Artificial Sequence
  Synthetic
gccaagcatttaggtgacactatagtagttcctcagctgcggtgagtttcagagctatgctggaaacagc

SEQ ID NO: 56864 - DNA, 70 bp, Artificial Sequence
  Synthetic
gccaagcatttaggtgacactatagtgctgataatcccagagcttgtttcagagctatgctggaaacagc

SEQ ID NO: 56865 - DNA, 70 bp, Artificial Sequence
  Synthetic
gccaagcatttaggtgacactatagtgtgtctgtggggatgtttcgtttcagagctatgctggaaacagc

SEQ ID NO: 56866 - DNA, 70 bp, Artificial Sequence
  Synthetic
gccaagcatttaggtgacactatagttggttcaccccatggtgaggtttcagagctatgctggaaacagc

SEQ ID NO: 56867 - DNA, 70 bp, Artificial Sequence
  Synthetic
gccaagcatttaggtgacactatagcccggggtggtgagctctaagtttcagagctatgctggaaacagc

SEQ ID NO: 56868 - DNA, 70 bp, Artificial Sequence
  Synthetic
gccaagcatttaggtgacactatagacattccagaagaaagatgcgtttcagagctatgctggaaacagc

SEQ ID NO: 56869 - DNA, 70 bp, Artificial Sequence
  Synthetic
gccaagcatttaggtgacactatagaacaagacgaaggcctcagggtttcagagctatgctggaaacagc

SEQ ID NO: 56870 - DNA, 70 bp, Artificial Sequence
  Synthetic
gccaagcatttaggtgacactatagtcgcgtcgacgtggcctgaagtttcagagctatgctggaaacagc

SEQ ID NO: 56871 - DNA, 70 bp, Artificial Sequence
  Synthetic
gccaagcatttaggtgacactatagcagctgtgccaggctttggggtttcagagctatgctggaaacagc

SEQ ID NO: 56872 - DNA, 70 bp, Artificial Sequence
  Synthetic
gccaagcatttaggtgacactatagtggcttcgtttgggacaaaagtttcagagctatgctggaaacagc

SEQ ID NO: 56873 - DNA, 70 bp, Artificial Sequence
  Synthetic
gccaagcatttaggtgacactatagtgaagatcgtttagggcccagtttcagagctatgctggaaacagc

SEQ ID NO: 56874 - DNA, 70 bp, Artificial Sequence
  Synthetic
gccaagcatttaggtgacactatagtatcagttcaatcaagccaggtttcagagctatgctggaaacagc

SEQ ID NO: 56875 - DNA, 70 bp, Artificial Sequence
  Synthetic
gccaagcatttaggtgacactatagttctaacagttctagaggccgtttcagagctatgctggaaacagc

SEQ ID NO: 56876 - DNA, 70 bp, Artificial Sequence
  Synthetic
gccaagcatttaggtgacactatagaacaagggggccaggcacaggtttcagagctatgctggaaacagc

SEQ ID NO: 56877 - DNA, 70 bp, Artificial Sequence
  Synthetic
gccaagcatttaggtgacactataggggcccgcggcgtacacaatgtttcagagctatgctggaaacagc

SEQ ID NO: 56878 - DNA, 70 bp, Artificial Sequence
  Synthetic
gccaagcatttaggtgacactataggtttgtctgactcctccaaggtttcagagctatgctggaaacagc

SEQ ID NO: 56879 - DNA, 70 bp, Artificial Sequence
  Synthetic
gccaagcatttaggtgacactatagttcacttttaggggacattcgtttcagagctatgctggaaacagc

SEQ ID NO: 56880 - DNA, 70 bp, Artificial Sequence
  Synthetic
gccaagcatttaggtgacactataggtgtactcggggcctcacttgtttcagagctatgctggaaacagc

SEQ ID NO: 56881 - DNA, 70 bp, Artificial Sequence
  Synthetic
gccaagcatttaggtgacactatagctggaagcagaggccagagtgtttcagagctatgctggaaacagc

SEQ ID NO: 56882 - DNA, 70 bp, Artificial Sequence
  Synthetic
gccaagcatttaggtgacactatagcctggcctggttgctgcagggtttcagagctatgctggaaacagc

SEQ ID NO: 56883 - DNA, 70 bp, Artificial Sequence
  Synthetic
gccaagcatttaggtgacactatagctctcatatgttagggagccgtttcagagctatgctggaaacagc

SEQ ID NO: 56884 - DNA, 70 bp, Artificial Sequence
  Synthetic
gccaagcatttaggtgacactatagactccctcctccactcgctcgtttcagagctatgctggaaacagc

SEQ ID NO: 56885 - DNA, 70 bp, Artificial Sequence
  Synthetic
gccaagcatttaggtgacactatagtcggctccctcgtcctaagcgtttcagagctatgctggaaacagc

SEQ ID NO: 56886 - DNA, 70 bp, Artificial Sequence
  Synthetic
gccaagcatttaggtgacactatagcagctgcaagccaaggagtggtttcagagctatgctggaaacagc

SEQ ID NO: 56887 - DNA, 70 bp, Artificial Sequence
  Synthetic
gccaagcatttaggtgacactatagtaaggagtggtcaaaaaatggtttcagagctatgctggaaacagc

SEQ ID NO: 56888 - DNA, 70 bp, Artificial Sequence
  Synthetic
gccaagcatttaggtgacactatagggaatcgtagcgacgttcaggtttcagagctatgctggaaacagc

SEQ ID NO: 56889 - DNA, 70 bp, Artificial Sequence
  Synthetic
gccaagcatttaggtgacactataggggatgactggacaagacttgtttcagagctatgctggaaacagc

SEQ ID NO: 56890 - DNA, 70 bp, Artificial Sequence
  Synthetic
gccaagcatttaggtgacactatagcagtgtcttgggccgccgcagtttcagagctatgctggaaacagc

SEQ ID NO: 56891 - DNA, 70 bp, Artificial Sequence
  Synthetic
gccaagcatttaggtgacactatagccacgtccttgtcctatcccgtttcagagctatgctggaaacagc

SEQ ID NO: 56892 - DNA, 70 bp, Artificial Sequence
  Synthetic
gccaagcatttaggtgacactataggtgcaacagttgctggtaaagtttcagagctatgctggaaacagc

SEQ ID NO: 56893 - DNA, 70 bp, Artificial Sequence
  Synthetic
gccaagcatttaggtgacactatagtcttgatgaattgtgcaaacgtttcagagctatgctggaaacagc

SEQ ID NO: 56894 - DNA, 70 bp, Artificial Sequence
  Synthetic
gccaagcatttaggtgacactatagtttccaagaaaatggcgctagtttcagagctatgctggaaacagc

SEQ ID NO: 56895 - DNA, 70 bp, Artificial Sequence
  Synthetic
gccaagcatttaggtgacactatagtagcttctgggcacttctaggtttcagagctatgctggaaacagc

SEQ ID NO: 56896 - DNA, 70 bp, Artificial Sequence
  Synthetic
gccaagcatttaggtgacactatagggtcagcttattctgcttgcgtttcagagctatgctggaaacagc

SEQ ID NO: 56897 - DNA, 70 bp, Artificial Sequence
  Synthetic
gccaagcatttaggtgacactatagggggaagtctagagctcttcgtttcagagctatgctggaaacagc

SEQ ID NO: 56898 - DNA, 70 bp, Artificial Sequence
  Synthetic
gccaagcatttaggtgacactatagtaagccaggtgggatcagtggtttcagagctatgctggaaacagc

SEQ ID NO: 56899 - DNA, 70 bp, Artificial Sequence
  Synthetic
gccaagcatttaggtgacactatagattcaacaatcacaggacacgtttcagagctatgctggaaacagc

SEQ ID NO: 56900 - DNA, 70 bp, Artificial Sequence
  Synthetic
gccaagcatttaggtgacactatagtggcaccaccatgagctttggtttcagagctatgctggaaacagc

SEQ ID NO: 56901 - DNA, 70 bp, Artificial Sequence
  Synthetic
gccaagcatttaggtgacactatagtgcagaagtcagctgtgaaagtttcagagctatgctggaaacagc

SEQ ID NO: 56902 - DNA, 70 bp, Artificial Sequence
  Synthetic
gccaagcatttaggtgacactatagatggccacagatttggtcacgtttcagagctatgctggaaacagc

SEQ ID NO: 56903 - DNA, 70 bp, Artificial Sequence
  Synthetic
gccaagcatttaggtgacactatagtgggaggcacagtggcctgagtttcagagctatgctggaaacagc

SEQ ID NO: 56904 - DNA, 70 bp, Artificial Sequence
  Synthetic
gccaagcatttaggtgacactatagcagcccacgagaagtgacgcgtttcagagctatgctggaaacagc

SEQ ID NO: 56905 - DNA, 70 bp, Artificial Sequence
  Synthetic
gccaagcatttaggtgacactatagtgagaccactgttgatgaacgtttcagagctatgctggaaacagc

SEQ ID NO: 56906 - DNA, 70 bp, Artificial Sequence
  Synthetic
gccaagcatttaggtgacactataggcggagtgggcggggcctgagtttcagagctatgctggaaacagc

SEQ ID NO: 56907 - DNA, 70 bp, Artificial Sequence
  Synthetic
gccaagcatttaggtgacactatagaactcagatgtgtccttacagtttcagagctatgctggaaacagc

SEQ ID NO: 56908 - DNA, 70 bp, Artificial Sequence
  Synthetic
gccaagcatttaggtgacactatagttaggcagatattatcagccgtttcagagctatgctggaaacagc

SEQ ID NO: 56909 - DNA, 70 bp, Artificial Sequence
  Synthetic
gccaagcatttaggtgacactatagatgaggcagtttagaccattgtttcagagctatgctggaaacagc

SEQ ID NO: 56910 - DNA, 70 bp, Artificial Sequence
  Synthetic
gccaagcatttaggtgacactatagttcagagcaggttattgcgcgtttcagagctatgctggaaacagc

SEQ ID NO: 56911 - DNA, 70 bp, Artificial Sequence
  Synthetic
gccaagcatttaggtgacactatagagctagccctgggccaggacgtttcagagctatgctggaaacagc

SEQ ID NO: 56912 - DNA, 70 bp, Artificial Sequence
  Synthetic
gccaagcatttaggtgacactatagcaaccgagtgcccgcggggcgtttcagagctatgctggaaacagc

SEQ ID NO: 56913 - DNA, 70 bp, Artificial Sequence
  Synthetic
gccaagcatttaggtgacactataggctgaaaaatctgagtgagagtttcagagctatgctggaaacagc

SEQ ID NO: 56914 - DNA, 70 bp, Artificial Sequence
  Synthetic
gccaagcatttaggtgacactatagatcatttctcatagctcaaggtttcagagctatgctggaaacagc

SEQ ID NO: 56915 - DNA, 70 bp, Artificial Sequence
  Synthetic
gccaagcatttaggtgacactataggctgaagaagaagcagaagagtttcagagctatgctggaaacagc

SEQ ID NO: 56916 - DNA, 70 bp, Artificial Sequence
  Synthetic
gccaagcatttaggtgacactatagcatggtttgcagggcatctggtttcagagctatgctggaaacagc

SEQ ID NO: 56917 - DNA, 70 bp, Artificial Sequence
  Synthetic
gccaagcatttaggtgacactatagttgaggtgggagattactcggtttcagagctatgctggaaacagc

SEQ ID NO: 56918 - DNA, 70 bp, Artificial Sequence
  Synthetic
gccaagcatttaggtgacactatagccagagctggcgcactcctggtttcagagctatgctggaaacagc

SEQ ID NO: 56919 - DNA, 70 bp, Artificial Sequence
  Synthetic
gccaagcatttaggtgacactataggcccaaagtgctaggattacgtttcagagctatgctggaaacagc

SEQ ID NO: 56920 - DNA, 70 bp, Artificial Sequence
  Synthetic
gccaagcatttaggtgacactatagaaagtgctggattacaggcggtttcagagctatgctggaaacagc

SEQ ID NO: 56921 - DNA, 70 bp, Artificial Sequence
  Synthetic
gccaagcatttaggtgacactatagtaaatctttaatgcactggcgtttcagagctatgctggaaacagc

SEQ ID NO: 56922 - DNA, 70 bp, Artificial Sequence
  Synthetic
gccaagcatttaggtgacactatagctagaaagtttgcgaagagagtttcagagctatgctggaaacagc

SEQ ID NO: 56923 - DNA, 70 bp, Artificial Sequence
  Synthetic
gccaagcatttaggtgacactatagaaaactacagttgcatgaacgtttcagagctatgctggaaacagc

SEQ ID NO: 56924 - DNA, 70 bp, Artificial Sequence
  Synthetic
gccaagcatttaggtgacactatagcgctggccgtggaacggtgagtttcagagctatgctggaaacagc

SEQ ID NO: 56925 - DNA, 70 bp, Artificial Sequence
  Synthetic
gccaagcatttaggtgacactatagagtttgctatttaacagaccgtttcagagctatgctggaaacagc

SEQ ID NO: 56926 - DNA, 70 bp, Artificial Sequence
  Synthetic
gccaagcatttaggtgacactatagggtcagtatatgctgtatctgtttcagagctatgctggaaacagc

SEQ ID NO: 56927 - DNA, 70 bp, Artificial Sequence
  Synthetic
gccaagcatttaggtgacactataggcaagagctggctaatgccagtttcagagctatgctggaaacagc

SEQ ID NO: 56928 - DNA, 70 bp, Artificial Sequence
  Synthetic
gccaagcatttaggtgacactatagggcaatccactcactagtttgtttcagagctatgctggaaacagc

SEQ ID NO: 56929 - DNA, 70 bp, Artificial Sequence
  Synthetic
gccaagcatttaggtgacactatagggtaccctgggggatctattgtttcagagctatgctggaaacagc

SEQ ID NO: 56930 - DNA, 70 bp, Artificial Sequence
  Synthetic
gccaagcatttaggtgacactatagcggtgaaattgtgcagcctggtttcagagctatgctggaaacagc

SEQ ID NO: 56931 - DNA, 70 bp, Artificial Sequence
  Synthetic
gccaagcatttaggtgacactatagcctcttcccttctgtctgaggtttcagagctatgctggaaacagc

SEQ ID NO: 56932 - DNA, 70 bp, Artificial Sequence
  Synthetic
gccaagcatttaggtgacactatagctgggacttgctgcagagtggtttcagagctatgctggaaacagc

SEQ ID NO: 56933 - DNA, 70 bp, Artificial Sequence
  Synthetic
gccaagcatttaggtgacactatagttcctggagacgctggagctgtttcagagctatgctggaaacagc

SEQ ID NO: 56934 - DNA, 70 bp, Artificial Sequence
  Synthetic
gccaagcatttaggtgacactatagagatgcaacattcactacacgtttcagagctatgctggaaacagc

SEQ ID NO: 56935 - DNA, 70 bp, Artificial Sequence
  Synthetic
gccaagcatttaggtgacactatagccacgcaggcttctttactggtttcagagctatgctggaaacagc

SEQ ID NO: 56936 - DNA, 70 bp, Artificial Sequence
  Synthetic
gccaagcatttaggtgacactataggcagtggcacttagataatcgtttcagagctatgctggaaacagc

SEQ ID NO: 56937 - DNA, 70 bp, Artificial Sequence
  Synthetic
gccaagcatttaggtgacactatagtgcagtgacagcttcagatggtttcagagctatgctggaaacagc

SEQ ID NO: 56938 - DNA, 70 bp, Artificial Sequence
  Synthetic
gccaagcatttaggtgacactatagaggtttgttacttggattgagtttcagagctatgctggaaacagc

SEQ ID NO: 56939 - DNA, 70 bp, Artificial Sequence
  Synthetic
gccaagcatttaggtgacactataggaccactctgtggtttagaagtttcagagctatgctggaaacagc

SEQ ID NO: 56940 - DNA, 70 bp, Artificial Sequence
  Synthetic
gccaagcatttaggtgacactatagctgaagttcaaggtagctaagtttcagagctatgctggaaacagc

SEQ ID NO: 56941 - DNA, 70 bp, Artificial Sequence
  Synthetic
gccaagcatttaggtgacactatagttttattgcagactgcacctgtttcagagctatgctggaaacagc

SEQ ID NO: 56942 - DNA, 70 bp, Artificial Sequence
  Synthetic
gccaagcatttaggtgacactatagaatgctagaatccaccttttgtttcagagctatgctggaaacagc

SEQ ID NO: 56943 - DNA, 70 bp, Artificial Sequence
  Synthetic
gccaagcatttaggtgacactataggcaatggcatgtgtgttcaggtttcagagctatgctggaaacagc

SEQ ID NO: 56944 - DNA, 70 bp, Artificial Sequence
  Synthetic
gccaagcatttaggtgacactatagttcagattctctgaagttcagtttcagagctatgctggaaacagc

SEQ ID NO: 56945 - DNA, 70 bp, Artificial Sequence
  Synthetic
gccaagcatttaggtgacactatagtgttcgcaagaagctggattgtttcagagctatgctggaaacagc

SEQ ID NO: 56946 - DNA, 70 bp, Artificial Sequence
  Synthetic
gccaagcatttaggtgacactatagtcagtcatcttttttgtctggtttcagagctatgctggaaacagc

SEQ ID NO: 56947 - DNA, 70 bp, Artificial Sequence
  Synthetic
gccaagcatttaggtgacactatagttcacaaagcaatggtgccagtttcagagctatgctggaaacagc

SEQ ID NO: 56948 - DNA, 70 bp, Artificial Sequence
  Synthetic
gccaagcatttaggtgacactataggtgcaagcacccaagcagaagtttcagagctatgctggaaacagc

SEQ ID NO: 56949 - DNA, 70 bp, Artificial Sequence
  Synthetic
gccaagcatttaggtgacactatagtccacgtcaattcctaaaacgtttcagagctatgctggaaacagc

SEQ ID NO: 56950 - DNA, 70 bp, Artificial Sequence
  Synthetic
gccaagcatttaggtgacactataggcttgggacattttacgctggtttcagagctatgctggaaacagc

SEQ ID NO: 56951 - DNA, 70 bp, Artificial Sequence
  Synthetic
gccaagcatttaggtgacactatagctggatgacctgtcttgagggtttcagagctatgctggaaacagc

SEQ ID NO: 56952 - DNA, 70 bp, Artificial Sequence
  Synthetic
gccaagcatttaggtgacactatagagccagggcaggttcagtccgtttcagagctatgctggaaacagc

SEQ ID NO: 56953 - DNA, 70 bp, Artificial Sequence
  Synthetic
gccaagcatttaggtgacactatagaagtctctgaataagaagtcgtttcagagctatgctggaaacagc

SEQ ID NO: 56954 - DNA, 70 bp, Artificial Sequence
  Synthetic
gccaagcatttaggtgacactataggggcctcagtgaagaattaggtttcagagctatgctggaaacagc

SEQ ID NO: 56955 - DNA, 70 bp, Artificial Sequence
  Synthetic
gccaagcatttaggtgacactataggaacaggtgactgaatctaagtttcagagctatgctggaaacagc

SEQ ID NO: 56956 - DNA, 70 bp, Artificial Sequence
  Synthetic
gccaagcatttaggtgacactatagtggatcagttggcattacaggtttcagagctatgctggaaacagc

SEQ ID NO: 56957 - DNA, 70 bp, Artificial Sequence
  Synthetic
gccaagcatttaggtgacactatagccattcttcctatggatggcgtttcagagctatgctggaaacagc

SEQ ID NO: 56958 - DNA, 70 bp, Artificial Sequence
  Synthetic
gccaagcatttaggtgacactatagaataccaaacccgctactgagtttcagagctatgctggaaacagc

SEQ ID NO: 56959 - DNA, 70 bp, Artificial Sequence
  Synthetic
gccaagcatttaggtgacactatagactagacatcaccgtaacgagtttcagagctatgctggaaacagc

SEQ ID NO: 56960 - DNA, 70 bp, Artificial Sequence
  Synthetic
gccaagcatttaggtgacactatagatgcacgtgcagacattatggtttcagagctatgctggaaacagc

SEQ ID NO: 56961 - DNA, 70 bp, Artificial Sequence
  Synthetic
gccaagcatttaggtgacactatagcaaggcatctcagctttctggtttcagagctatgctggaaacagc

SEQ ID NO: 56962 - DNA, 70 bp, Artificial Sequence
  Synthetic
gccaagcatttaggtgacactatagtcaacttactacagctggtggtttcagagctatgctggaaacagc

SEQ ID NO: 56963 - DNA, 70 bp, Artificial Sequence
  Synthetic
gccaagcatttaggtgacactatagcactcggctcctgggttcctgtttcagagctatgctggaaacagc

SEQ ID NO: 56964 - DNA, 70 bp, Artificial Sequence
  Synthetic
gccaagcatttaggtgacactatagccctgctggaccggccttaggtttcagagctatgctggaaacagc

SEQ ID NO: 56965 - DNA, 70 bp, Artificial Sequence
  Synthetic
gccaagcatttaggtgacactatagcattccccggaccgggatccgtttcagagctatgctggaaacagc

SEQ ID NO: 56966 - DNA, 70 bp, Artificial Sequence
  Synthetic
gccaagcatttaggtgacactataggctggagagtaccgtgtgaggtttcagagctatgctggaaacagc

SEQ ID NO: 56967 - DNA, 70 bp, Artificial Sequence
  Synthetic
gccaagcatttaggtgacactatagatggagagcacggtctaggtgtttcagagctatgctggaaacagc

SEQ ID NO: 56968 - DNA, 70 bp, Artificial Sequence
  Synthetic
gccaagcatttaggtgacactataggaacctgtgggaccctagccgtttcagagctatgctggaaacagc

SEQ ID NO: 56969 - DNA, 70 bp, Artificial Sequence
  Synthetic
gccaagcatttaggtgacactatagtggaagagagtgtggtgtgagtttcagagctatgctggaaacagc

SEQ ID NO: 56970 - DNA, 70 bp, Artificial Sequence
  Synthetic
gccaagcatttaggtgacactatagggcagaagctacatcatcaagtttcagagctatgctggaaacagc

SEQ ID NO: 56971 - DNA, 70 bp, Artificial Sequence
  Synthetic
gccaagcatttaggtgacactatagtaatgttgaccagattgtccgtttcagagctatgctggaaacagc

SEQ ID NO: 56972 - DNA, 70 bp, Artificial Sequence
  Synthetic
gccaagcatttaggtgacactatagacccaagcccctggtctcacgtttcagagctatgctggaaacagc

SEQ ID NO: 56973 - DNA, 70 bp, Artificial Sequence
  Synthetic
gccaagcatttaggtgacactatagatcaagtgctagtctacctggtttcagagctatgctggaaacagc

SEQ ID NO: 56974 - DNA, 70 bp, Artificial Sequence
  Synthetic
gccaagcatttaggtgacactatagcgaatggtttcttctaactcgtttcagagctatgctggaaacagc

SEQ ID NO: 56975 - DNA, 70 bp, Artificial Sequence
  Synthetic
gccaagcatttaggtgacactataggctgttggcaccaaaaagctgtttcagagctatgctggaaacagc

SEQ ID NO: 56976 - DNA, 70 bp, Artificial Sequence
  Synthetic
gccaagcatttaggtgacactatagaacattcaagatggtagtgagtttcagagctatgctggaaacagc

SEQ ID NO: 56977 - DNA, 70 bp, Artificial Sequence
  Synthetic
gccaagcatttaggtgacactatagcagaggaagatgggaaagaagtttcagagctatgctggaaacagc

SEQ ID NO: 56978 - DNA, 70 bp, Artificial Sequence
  Synthetic
gccaagcatttaggtgacactatagtcaatgagtacttctgctgagtttcagagctatgctggaaacagc

SEQ ID NO: 56979 - DNA, 70 bp, Artificial Sequence
  Synthetic
gccaagcatttaggtgacactatagggacaaggagaaaggaggaagtttcagagctatgctggaaacagc

SEQ ID NO: 56980 - DNA, 70 bp, Artificial Sequence
  Synthetic
gccaagcatttaggtgacactatagagaccagagtattattgctagtttcagagctatgctggaaacagc

SEQ ID NO: 56981 - DNA, 70 bp, Artificial Sequence
  Synthetic
gccaagcatttaggtgacactatagacagaagttggcttcagagcgtttcagagctatgctggaaacagc

SEQ ID NO: 56982 - DNA, 70 bp, Artificial Sequence
  Synthetic
gccaagcatttaggtgacactatagaggatgtcctgctgtcacacgtttcagagctatgctggaaacagc

SEQ ID NO: 56983 - DNA, 70 bp, Artificial Sequence
  Synthetic
gccaagcatttaggtgacactatagataggggaccccttggcatagtttcagagctatgctggaaacagc

SEQ ID NO: 56984 - DNA, 70 bp, Artificial Sequence
  Synthetic
gccaagcatttaggtgacactatagggtgcccgccgtcgtcagcggtttcagagctatgctggaaacagc

SEQ ID NO: 56985 - DNA, 70 bp, Artificial Sequence
  Synthetic
gccaagcatttaggtgacactatagtgagccactgcttacctgaggtttcagagctatgctggaaacagc

SEQ ID NO: 56986 - DNA, 70 bp, Artificial Sequence
  Synthetic
gccaagcatttaggtgacactatagaatcggactacctcataaatgtttcagagctatgctggaaacagc

SEQ ID NO: 56987 - DNA, 70 bp, Artificial Sequence
  Synthetic
gccaagcatttaggtgacactatagtgaggctttgttactttgttgtttcagagctatgctggaaacagc

SEQ ID NO: 56988 - DNA, 70 bp, Artificial Sequence
  Synthetic
gccaagcatttaggtgacactatagaattggtataagagagacaggtttcagagctatgctggaaacagc

SEQ ID NO: 56989 - DNA, 70 bp, Artificial Sequence
  Synthetic
gccaagcatttaggtgacactatagagtgtcttctgttgcagaatgtttcagagctatgctggaaacagc

SEQ ID NO: 56990 - DNA, 70 bp, Artificial Sequence
  Synthetic
gccaagcatttaggtgacactataggtgaagttcatctgccaatggtttcagagctatgctggaaacagc

SEQ ID NO: 56991 - DNA, 70 bp, Artificial Sequence
  Synthetic
gccaagcatttaggtgacactatagccagcggtcaacagaccaacgtttcagagctatgctggaaacagc

SEQ ID NO: 56992 - DNA, 70 bp, Artificial Sequence
  Synthetic
gccaagcatttaggtgacactatagagaatgtgggcatttagaccgtttcagagctatgctggaaacagc

SEQ ID NO: 56993 - DNA, 70 bp, Artificial Sequence
  Synthetic
gccaagcatttaggtgacactatagaggtcaggatgagtccgtgcgtttcagagctatgctggaaacagc

SEQ ID NO: 56994 - DNA, 70 bp, Artificial Sequence
  Synthetic
gccaagcatttaggtgacactatagtcatgtcactcagcagttccgtttcagagctatgctggaaacagc

SEQ ID NO: 56995 - DNA, 70 bp, Artificial Sequence
  Synthetic
gccaagcatttaggtgacactatagtgtacagactcctcctgagggtttcagagctatgctggaaacagc

SEQ ID NO: 56996 - DNA, 70 bp, Artificial Sequence
  Synthetic
gccaagcatttaggtgacactataggaagatgatggactaccctggtttcagagctatgctggaaacagc

SEQ ID NO: 56997 - DNA, 70 bp, Artificial Sequence
  Synthetic
gccaagcatttaggtgacactatagctcggcacaacgaactctgagtttcagagctatgctggaaacagc

SEQ ID NO: 56998 - DNA, 70 bp, Artificial Sequence
  Synthetic
gccaagcatttaggtgacactatagacagcagctaagaaaattgagtttcagagctatgctggaaacagc

SEQ ID NO: 56999 - DNA, 70 bp, Artificial Sequence
  Synthetic
gccaagcatttaggtgacactatagtatctactaagaccacagtggtttcagagctatgctggaaacagc

SEQ ID NO: 57000 - DNA, 70 bp, Artificial Sequence
  Synthetic
gccaagcatttaggtgacactatagggtgaaactctacacagaaggtttcagagctatgctggaaacagc

SEQ ID NO: 57001 - DNA, 70 bp, Artificial Sequence
  Synthetic
gccaagcatttaggtgacactatagcttcctcctaccaactcctggtttcagagctatgctggaaacagc

SEQ ID NO: 57002 - DNA, 70 bp, Artificial Sequence
  Synthetic
gccaagcatttaggtgacactatagtaggctcaggtgcccagtccgtttcagagctatgctggaaacagc

SEQ ID NO: 57003 - DNA, 70 bp, Artificial Sequence
  Synthetic
gccaagcatttaggtgacactatagacccagagctacttcatcatgtttcagagctatgctggaaacagc

SEQ ID NO: 57004 - DNA, 70 bp, Artificial Sequence
  Synthetic
gccaagcatttaggtgacactatagctctatttgtttgagtgctcgtttcagagctatgctggaaacagc

SEQ ID NO: 57005 - DNA, 70 bp, Artificial Sequence
  Synthetic
gccaagcatttaggtgacactataggcacccaatgagtgttaaaggtttcagagctatgctggaaacagc

SEQ ID NO: 57006 - DNA, 70 bp, Artificial Sequence
  Synthetic
gccaagcatttaggtgacactatagggcattgaattcatcgatccgtttcagagctatgctggaaacagc

SEQ ID NO: 57007 - DNA, 70 bp, Artificial Sequence
  Synthetic
gccaagcatttaggtgacactatagtattacgctttgcttctttggtttcagagctatgctggaaacagc

SEQ ID NO: 57008 - DNA, 70 bp, Artificial Sequence
  Synthetic
gccaagcatttaggtgacactatagccaaggactcctgggaagacgtttcagagctatgctggaaacagc

SEQ ID NO: 57009 - DNA, 70 bp, Artificial Sequence
  Synthetic
gccaagcatttaggtgacactatagtcatttgtggtagatgatgagtttcagagctatgctggaaacagc

SEQ ID NO: 57010 - DNA, 70 bp, Artificial Sequence
  Synthetic
gccaagcatttaggtgacactatagttgaaggctaaaagacacttgtttcagagctatgctggaaacagc

SEQ ID NO: 57011 - DNA, 70 bp, Artificial Sequence
  Synthetic
gccaagcatttaggtgacactatagaggatgcctcttcttcaacagtttcagagctatgctggaaacagc

SEQ ID NO: 57012 - DNA, 70 bp, Artificial Sequence
  Synthetic
gccaagcatttaggtgacactatagtgaggagggtggcctaaggtgtttcagagctatgctggaaacagc

SEQ ID NO: 57013 - DNA, 70 bp, Artificial Sequence
  Synthetic
gccaagcatttaggtgacactataggggtgcagaatggggtgcctgtttcagagctatgctggaaacagc

SEQ ID NO: 57014 - DNA, 70 bp, Artificial Sequence
  Synthetic
gccaagcatttaggtgacactatagctgctagatcaatgactgttgtttcagagctatgctggaaacagc

SEQ ID NO: 57015 - DNA, 70 bp, Artificial Sequence
  Synthetic
gccaagcatttaggtgacactataggcctacgagatccactgctagtttcagagctatgctggaaacagc

SEQ ID NO: 57016 - DNA, 70 bp, Artificial Sequence
  Synthetic
gccaagcatttaggtgacactataggacatcttaggctcagtgccgtttcagagctatgctggaaacagc

SEQ ID NO: 57017 - DNA, 70 bp, Artificial Sequence
  Synthetic
gccaagcatttaggtgacactatagcgctgccgcccaagcctgaggtttcagagctatgctggaaacagc

SEQ ID NO: 57018 - DNA, 70 bp, Artificial Sequence
  Synthetic
gccaagcatttaggtgacactatagagaccccacccaacctgactgtttcagagctatgctggaaacagc

SEQ ID NO: 57019 - DNA, 70 bp, Artificial Sequence
  Synthetic
gccaagcatttaggtgacactatagccaggagaagcaggctctgagtttcagagctatgctggaaacagc

SEQ ID NO: 57020 - DNA, 70 bp, Artificial Sequence
  Synthetic
gccaagcatttaggtgacactatagccctgacacggtcatcaggggtttcagagctatgctggaaacagc

SEQ ID NO: 57021 - DNA, 70 bp, Artificial Sequence
  Synthetic
gccaagcatttaggtgacactataggtccagccacctggtgtcacgtttcagagctatgctggaaacagc

SEQ ID NO: 57022 - DNA, 70 bp, Artificial Sequence
  Synthetic
gccaagcatttaggtgacactatagtgagtgtttatcaactcagcgtttcagagctatgctggaaacagc

SEQ ID NO: 57023 - DNA, 70 bp, Artificial Sequence
  Synthetic
gccaagcatttaggtgacactataggacctgaccctaacactctggtttcagagctatgctggaaacagc

SEQ ID NO: 57024 - DNA, 70 bp, Artificial Sequence
  Synthetic
gccaagcatttaggtgacactatagcggaacaggcgctagggcccgtttcagagctatgctggaaacagc

SEQ ID NO: 57025 - DNA, 70 bp, Artificial Sequence
  Synthetic
gccaagcatttaggtgacactataggacaaaaaacacacctgaccgtttcagagctatgctggaaacagc

SEQ ID NO: 57026 - DNA, 70 bp, Artificial Sequence
  Synthetic
gccaagcatttaggtgacactataggacagaggatgtggctctccgtttcagagctatgctggaaacagc

SEQ ID NO: 57027 - DNA, 70 bp, Artificial Sequence
  Synthetic
gccaagcatttaggtgacactatagcagtttactgaaacccaccagtttcagagctatgctggaaacagc

SEQ ID NO: 57028 - DNA, 70 bp, Artificial Sequence
  Synthetic
gccaagcatttaggtgacactatagactgttggttaaacttctgcgtttcagagctatgctggaaacagc

SEQ ID NO: 57029 - DNA, 70 bp, Artificial Sequence
  Synthetic
gccaagcatttaggtgacactatagggagtcttaaagcgttagtagtttcagagctatgctggaaacagc

SEQ ID NO: 57030 - DNA, 70 bp, Artificial Sequence
  Synthetic
gccaagcatttaggtgacactatagtttcatggctgttgacctacgtttcagagctatgctggaaacagc

SEQ ID NO: 57031 - DNA, 70 bp, Artificial Sequence
  Synthetic
gccaagcatttaggtgacactatagccatgctagctctataagccgtttcagagctatgctggaaacagc

SEQ ID NO: 57032 - DNA, 70 bp, Artificial Sequence
  Synthetic
gccaagcatttaggtgacactataggagtgaagccctgccatagggtttcagagctatgctggaaacagc

SEQ ID NO: 57033 - DNA, 70 bp, Artificial Sequence
  Synthetic
gccaagcatttaggtgacactatagaaagacaacccatcaatatcgtttcagagctatgctggaaacagc

SEQ ID NO: 57034 - DNA, 70 bp, Artificial Sequence
  Synthetic
gccaagcatttaggtgacactatagggaggatgaagacgaggacagtttcagagctatgctggaaacagc

SEQ ID NO: 57035 - DNA, 70 bp, Artificial Sequence
  Synthetic
gccaagcatttaggtgacactatagacacatacatacaagagtcagtttcagagctatgctggaaacagc

SEQ ID NO: 57036 - DNA, 70 bp, Artificial Sequence
  Synthetic
gccaagcatttaggtgacactatagccaatctccataaatacggagtttcagagctatgctggaaacagc

SEQ ID NO: 57037 - DNA, 70 bp, Artificial Sequence
  Synthetic
gccaagcatttaggtgacactatagacctgatgatattagcactggtttcagagctatgctggaaacagc

SEQ ID NO: 57038 - DNA, 70 bp, Artificial Sequence
  Synthetic
gccaagcatttaggtgacactatagctcctccatcctcagcacaggtttcagagctatgctggaaacagc

SEQ ID NO: 57039 - DNA, 70 bp, Artificial Sequence
  Synthetic
gccaagcatttaggtgacactatagccataccaaggacaaggtacgtttcagagctatgctggaaacagc

SEQ ID NO: 57040 - DNA, 70 bp, Artificial Sequence
  Synthetic
gccaagcatttaggtgacactataggaccgaattcctacttaacagtttcagagctatgctggaaacagc

SEQ ID NO: 57041 - DNA, 70 bp, Artificial Sequence
  Synthetic
gccaagcatttaggtgacactatagtatgttagcaccatgtgatggtttcagagctatgctggaaacagc

SEQ ID NO: 57042 - DNA, 70 bp, Artificial Sequence
  Synthetic
gccaagcatttaggtgacactatagatgtcttgctgtggaagactgtttcagagctatgctggaaacagc

SEQ ID NO: 57043 - DNA, 70 bp, Artificial Sequence
  Synthetic
gccaagcatttaggtgacactatagtttactgcccacgccctacagtttcagagctatgctggaaacagc

SEQ ID NO: 57044 - DNA, 70 bp, Artificial Sequence
  Synthetic
gccaagcatttaggtgacactatagcctcccggcctgtctcacttgtttcagagctatgctggaaacagc

SEQ ID NO: 57045 - DNA, 70 bp, Artificial Sequence
  Synthetic
gccaagcatttaggtgacactatagccccagcacaaccaaaactagtttcagagctatgctggaaacagc

SEQ ID NO: 57046 - DNA, 70 bp, Artificial Sequence
  Synthetic
gccaagcatttaggtgacactataggtcagcgcacgacagtcacggtttcagagctatgctggaaacagc

SEQ ID NO: 57047 - DNA, 70 bp, Artificial Sequence
  Synthetic
gccaagcatttaggtgacactatagtttggtctgttatctgctgtgtttcagagctatgctggaaacagc

SEQ ID NO: 57048 - DNA, 70 bp, Artificial Sequence
  Synthetic
gccaagcatttaggtgacactatagcaagagacgcagatctgagggtttcagagctatgctggaaacagc

SEQ ID NO: 57049 - DNA, 70 bp, Artificial Sequence
  Synthetic
gccaagcatttaggtgacactatagttgtgttaactgttgttgtggtttcagagctatgctggaaacagc

SEQ ID NO: 57050 - DNA, 70 bp, Artificial Sequence
  Synthetic
gccaagcatttaggtgacactatagtctggcaactaaataagctggtttcagagctatgctggaaacagc

SEQ ID NO: 57051 - DNA, 70 bp, Artificial Sequence
  Synthetic
gccaagcatttaggtgacactatagctggagcaaggccagtgaaggtttcagagctatgctggaaacagc

SEQ ID NO: 57052 - DNA, 70 bp, Artificial Sequence
  Synthetic
gccaagcatttaggtgacactataggcagtgggggctatattaaggtttcagagctatgctggaaacagc

SEQ ID NO: 57053 - DNA, 70 bp, Artificial Sequence
  Synthetic
gccaagcatttaggtgacactatagacttcacgcaaacttcttctgtttcagagctatgctggaaacagc

SEQ ID NO: 57054 - DNA, 70 bp, Artificial Sequence
  Synthetic
gccaagcatttaggtgacactatagaaagttcttcttggttgaacgtttcagagctatgctggaaacagc

SEQ ID NO: 57055 - DNA, 70 bp, Artificial Sequence
  Synthetic
gccaagcatttaggtgacactatagacaagctcactgctgagagtgtttcagagctatgctggaaacagc

SEQ ID NO: 57056 - DNA, 70 bp, Artificial Sequence
  Synthetic
gccaagcatttaggtgacactatagagccagatgtttcaaatcaggtttcagagctatgctggaaacagc

SEQ ID NO: 57057 - DNA, 70 bp, Artificial Sequence
  Synthetic
gccaagcatttaggtgacactatagaggccacgttcagaagacgagtttcagagctatgctggaaacagc

SEQ ID NO: 57058 - DNA, 70 bp, Artificial Sequence
  Synthetic
gccaagcatttaggtgacactatagtagaagaatagctctagatggtttcagagctatgctggaaacagc

SEQ ID NO: 57059 - DNA, 70 bp, Artificial Sequence
  Synthetic
gccaagcatttaggtgacactatagaaatgtctgagtctctttcagtttcagagctatgctggaaacagc

SEQ ID NO: 57060 - DNA, 70 bp, Artificial Sequence
  Synthetic
gccaagcatttaggtgacactatagtaacctctttggaattgctcgtttcagagctatgctggaaacagc

SEQ ID NO: 57061 - DNA, 70 bp, Artificial Sequence
  Synthetic
gccaagcatttaggtgacactatagtaagctcacgttgaataactgtttcagagctatgctggaaacagc

SEQ ID NO: 57062 - DNA, 70 bp, Artificial Sequence
  Synthetic
gccaagcatttaggtgacactatagtccattcaaaccttctgacagtttcagagctatgctggaaacagc

SEQ ID NO: 57063 - DNA, 70 bp, Artificial Sequence
  Synthetic
gccaagcatttaggtgacactatagtgttcctgaaaatgaggcacgtttcagagctatgctggaaacagc

SEQ ID NO: 57064 - DNA, 70 bp, Artificial Sequence
  Synthetic
gccaagcatttaggtgacactatagagcaggtgggagggggctaggtttcagagctatgctggaaacagc

SEQ ID NO: 57065 - DNA, 70 bp, Artificial Sequence
  Synthetic
gccaagcatttaggtgacactataggaaaggtaccttgaagaggagtttcagagctatgctggaaacagc

SEQ ID NO: 57066 - DNA, 70 bp, Artificial Sequence
  Synthetic
gccaagcatttaggtgacactatagcccagtggagagtcacatctgtttcagagctatgctggaaacagc

SEQ ID NO: 57067 - DNA, 70 bp, Artificial Sequence
  Synthetic
gccaagcatttaggtgacactataggctcgatgagaagacaggcagtttcagagctatgctggaaacagc

SEQ ID NO: 57068 - DNA, 70 bp, Artificial Sequence
  Synthetic
gccaagcatttaggtgacactataggccacactccaaggtcacttgtttcagagctatgctggaaacagc

SEQ ID NO: 57069 - DNA, 70 bp, Artificial Sequence
  Synthetic
gccaagcatttaggtgacactataggatccttaaggatgtcagtggtttcagagctatgctggaaacagc

SEQ ID NO: 57070 - DNA, 70 bp, Artificial Sequence
  Synthetic
gccaagcatttaggtgacactataggctgcagctcagacgtgacagtttcagagctatgctggaaacagc

SEQ ID NO: 57071 - DNA, 70 bp, Artificial Sequence
  Synthetic
gccaagcatttaggtgacactatagcaggtgggtggtgggtcaccgtttcagagctatgctggaaacagc

SEQ ID NO: 57072 - DNA, 70 bp, Artificial Sequence
  Synthetic
gccaagcatttaggtgacactataggtggagggctgacaaggagcgtttcagagctatgctggaaacagc

SEQ ID NO: 57073 - DNA, 70 bp, Artificial Sequence
  Synthetic
gccaagcatttaggtgacactataggtctgtaaacgttctgttacgtttcagagctatgctggaaacagc

SEQ ID NO: 57074 - DNA, 70 bp, Artificial Sequence
  Synthetic
gccaagcatttaggtgacactatagattctgttttcatttgctccgtttcagagctatgctggaaacagc

SEQ ID NO: 57075 - DNA, 70 bp, Artificial Sequence
  Synthetic
gccaagcatttaggtgacactatagcctgccactcgaagtcaaaggtttcagagctatgctggaaacagc

SEQ ID NO: 57076 - DNA, 70 bp, Artificial Sequence
  Synthetic
gccaagcatttaggtgacactatagagtgcgggacaagatggagggtttcagagctatgctggaaacagc

SEQ ID NO: 57077 - DNA, 70 bp, Artificial Sequence
  Synthetic
gccaagcatttaggtgacactatagtcaagctgaaatagcacagcgtttcagagctatgctggaaacagc

SEQ ID NO: 57078 - DNA, 70 bp, Artificial Sequence
  Synthetic
gccaagcatttaggtgacactatagattcgagcactaactatgatgtttcagagctatgctggaaacagc

SEQ ID NO: 57079 - DNA, 70 bp, Artificial Sequence
  Synthetic
gccaagcatttaggtgacactataggcctgcctcagcttaggacagtttcagagctatgctggaaacagc

SEQ ID NO: 57080 - DNA, 70 bp, Artificial Sequence
  Synthetic
gccaagcatttaggtgacactatagtcagagctggaatttactgcgtttcagagctatgctggaaacagc

SEQ ID NO: 57081 - DNA, 70 bp, Artificial Sequence
  Synthetic
gccaagcatttaggtgacactatagaagggtggttttcctactgcgtttcagagctatgctggaaacagc

SEQ ID NO: 57082 - DNA, 70 bp, Artificial Sequence
  Synthetic
gccaagcatttaggtgacactatagcaggatcttcaagtaagttggtttcagagctatgctggaaacagc

SEQ ID NO: 57083 - DNA, 70 bp, Artificial Sequence
  Synthetic
gccaagcatttaggtgacactatagaaaaagacatacgattggaggtttcagagctatgctggaaacagc

SEQ ID NO: 57084 - DNA, 70 bp, Artificial Sequence
  Synthetic
gccaagcatttaggtgacactatagagcatcttgaagtctttcacgtttcagagctatgctggaaacagc

SEQ ID NO: 57085 - DNA, 70 bp, Artificial Sequence
  Synthetic
gccaagcatttaggtgacactatagtgtaaaaggaaaaccaggaagtttcagagctatgctggaaacagc

SEQ ID NO: 57086 - DNA, 70 bp, Artificial Sequence
  Synthetic
gccaagcatttaggtgacactatagaggcttgcactcgcaagagagtttcagagctatgctggaaacagc

SEQ ID NO: 57087 - DNA, 70 bp, Artificial Sequence
  Synthetic
gccaagcatttaggtgacactatagtggaagattgatgtcccaaagtttcagagctatgctggaaacagc

SEQ ID NO: 57088 - DNA, 70 bp, Artificial Sequence
  Synthetic
gccaagcatttaggtgacactatagcatccagaagctattacatggtttcagagctatgctggaaacagc

SEQ ID NO: 57089 - DNA, 70 bp, Artificial Sequence
  Synthetic
gccaagcatttaggtgacactataggctgcccagatcctcagaaggtttcagagctatgctggaaacagc

SEQ ID NO: 57090 - DNA, 70 bp, Artificial Sequence
  Synthetic
gccaagcatttaggtgacactatagctgataaatctctgggaagcgtttcagagctatgctggaaacagc

SEQ ID NO: 57091 - DNA, 70 bp, Artificial Sequence
  Synthetic
gccaagcatttaggtgacactatagccagaagctgggctaactgagtttcagagctatgctggaaacagc

SEQ ID NO: 57092 - DNA, 70 bp, Artificial Sequence
  Synthetic
gccaagcatttaggtgacactataggccgcaggggcgctctgaaagtttcagagctatgctggaaacagc

SEQ ID NO: 57093 - DNA, 70 bp, Artificial Sequence
  Synthetic
gccaagcatttaggtgacactataggcagcccgcgagggaatgcggtttcagagctatgctggaaacagc

SEQ ID NO: 57094 - DNA, 70 bp, Artificial Sequence
  Synthetic
gccaagcatttaggtgacactatagggacccttcatcatcattaagtttcagagctatgctggaaacagc

SEQ ID NO: 57095 - DNA, 70 bp, Artificial Sequence
  Synthetic
gccaagcatttaggtgacactataggttaagctagctgctgtttagtttcagagctatgctggaaacagc

SEQ ID NO: 57096 - DNA, 70 bp, Artificial Sequence
  Synthetic
gccaagcatttaggtgacactatagctctggctccagggaatgtggtttcagagctatgctggaaacagc

SEQ ID NO: 57097 - DNA, 70 bp, Artificial Sequence
  Synthetic
gccaagcatttaggtgacactatagtgcaattctctctaggtagagtttcagagctatgctggaaacagc

SEQ ID NO: 57098 - DNA, 70 bp, Artificial Sequence
  Synthetic
gccaagcatttaggtgacactatagcgggcagcactcagctgctggtttcagagctatgctggaaacagc

SEQ ID NO: 57099 - DNA, 70 bp, Artificial Sequence
  Synthetic
gccaagcatttaggtgacactatagtgagacaaaagctctcaggcgtttcagagctatgctggaaacagc

SEQ ID NO: 57100 - DNA, 70 bp, Artificial Sequence
  Synthetic
gccaagcatttaggtgacactatagccagaagcagatctcttctggtttcagagctatgctggaaacagc

SEQ ID NO: 57101 - DNA, 70 bp, Artificial Sequence
  Synthetic
gccaagcatttaggtgacactatagaccaagcagaatacactttggtttcagagctatgctggaaacagc

SEQ ID NO: 57102 - DNA, 70 bp, Artificial Sequence
  Synthetic
gccaagcatttaggtgacactatagcctgggcctggacctcagccgtttcagagctatgctggaaacagc

SEQ ID NO: 57103 - DNA, 70 bp, Artificial Sequence
  Synthetic
gccaagcatttaggtgacactataggcctcacaggcctccatgacgtttcagagctatgctggaaacagc

SEQ ID NO: 57104 - DNA, 70 bp, Artificial Sequence
  Synthetic
gccaagcatttaggtgacactatagtggaggaagagaaagggtatgtttcagagctatgctggaaacagc

SEQ ID NO: 57105 - DNA, 70 bp, Artificial Sequence
  Synthetic
gccaagcatttaggtgacactatagacatcgtagccatctggggggtttcagagctatgctggaaacagc

SEQ ID NO: 57106 - DNA, 70 bp, Artificial Sequence
  Synthetic
gccaagcatttaggtgacactatagggccgtaccactgtggctgcgtttcagagctatgctggaaacagc

SEQ ID NO: 57107 - DNA, 70 bp, Artificial Sequence
  Synthetic
gccaagcatttaggtgacactatagtacaagcacctggatatgtggtttcagagctatgctggaaacagc

SEQ ID NO: 57108 - DNA, 70 bp, Artificial Sequence
  Synthetic
gccaagcatttaggtgacactatagcgagatggaaggacacttatgtttcagagctatgctggaaacagc

SEQ ID NO: 57109 - DNA, 70 bp, Artificial Sequence
  Synthetic
gccaagcatttaggtgacactatagtcatcaagagtatctgctcggtttcagagctatgctggaaacagc

SEQ ID NO: 57110 - DNA, 70 bp, Artificial Sequence
  Synthetic
gccaagcatttaggtgacactatagtggcaccgccagcctcatcggtttcagagctatgctggaaacagc

SEQ ID NO: 57111 - DNA, 70 bp, Artificial Sequence
  Synthetic
gccaagcatttaggtgacactatagcccccaaaaaactgtaagtggtttcagagctatgctggaaacagc

SEQ ID NO: 57112 - DNA, 70 bp, Artificial Sequence
  Synthetic
gccaagcatttaggtgacactatagactgtgcaagatgaaccagcgtttcagagctatgctggaaacagc

SEQ ID NO: 57113 - DNA, 70 bp, Artificial Sequence
  Synthetic
gccaagcatttaggtgacactataggtgtacggactcaggatgacgtttcagagctatgctggaaacagc

SEQ ID NO: 57114 - DNA, 70 bp, Artificial Sequence
  Synthetic
gccaagcatttaggtgacactatagcacagcttttggaccctaaagtttcagagctatgctggaaacagc

SEQ ID NO: 57115 - DNA, 70 bp, Artificial Sequence
  Synthetic
gccaagcatttaggtgacactatagtcgtgggggccgggagtttggtttcagagctatgctggaaacagc

SEQ ID NO: 57116 - DNA, 70 bp, Artificial Sequence
  Synthetic
gccaagcatttaggtgacactatagccgggactggcagggtgtgagtttcagagctatgctggaaacagc

SEQ ID NO: 57117 - DNA, 70 bp, Artificial Sequence
  Synthetic
gccaagcatttaggtgacactatagccctgcagcagaaacagtgagtttcagagctatgctggaaacagc

SEQ ID NO: 57118 - DNA, 70 bp, Artificial Sequence
  Synthetic
gccaagcatttaggtgacactataggttgcccctccactgagagtgtttcagagctatgctggaaacagc

SEQ ID NO: 57119 - DNA, 70 bp, Artificial Sequence
  Synthetic
gccaagcatttaggtgacactatagaagaagcctggcagacaggcgtttcagagctatgctggaaacagc

SEQ ID NO: 57120 - DNA, 70 bp, Artificial Sequence
  Synthetic
gccaagcatttaggtgacactatagagagtctcactggaatgcaggtttcagagctatgctggaaacagc

SEQ ID NO: 57121 - DNA, 70 bp, Artificial Sequence
  Synthetic
gccaagcatttaggtgacactatagaggaaactcattcacacttcgtttcagagctatgctggaaacagc

SEQ ID NO: 57122 - DNA, 70 bp, Artificial Sequence
  Synthetic
gccaagcatttaggtgacactatagacatcagtacacagaagagagtttcagagctatgctggaaacagc

SEQ ID NO: 57123 - DNA, 70 bp, Artificial Sequence
  Synthetic
gccaagcatttaggtgacactatagcagcagcaggacgcctagccgtttcagagctatgctggaaacagc

SEQ ID NO: 57124 - DNA, 70 bp, Artificial Sequence
  Synthetic
gccaagcatttaggtgacactatagttaaattctgtagcacactggtttcagagctatgctggaaacagc

SEQ ID NO: 57125 - DNA, 70 bp, Artificial Sequence
  Synthetic
gccaagcatttaggtgacactatagtggactctgaacaaaactaagtttcagagctatgctggaaacagc

SEQ ID NO: 57126 - DNA, 70 bp, Artificial Sequence
  Synthetic
gccaagcatttaggtgacactataggatccaaatggcatctcagcgtttcagagctatgctggaaacagc

SEQ ID NO: 57127 - DNA, 70 bp, Artificial Sequence
  Synthetic
gccaagcatttaggtgacactatagggaagggggcccggctccctgtttcagagctatgctggaaacagc

SEQ ID NO: 57128 - DNA, 70 bp, Artificial Sequence
  Synthetic
gccaagcatttaggtgacactatagcgactaaactttcccgactcgtttcagagctatgctggaaacagc

SEQ ID NO: 57129 - DNA, 70 bp, Artificial Sequence
  Synthetic
gccaagcatttaggtgacactataggcaggtaggcatgttctcaggtttcagagctatgctggaaacagc

SEQ ID NO: 57130 - DNA, 70 bp, Artificial Sequence
  Synthetic
gccaagcatttaggtgacactatagaggtgtctggggtgctcagggtttcagagctatgctggaaacagc

SEQ ID NO: 57131 - DNA, 70 bp, Artificial Sequence
  Synthetic
gccaagcatttaggtgacactatagggggggaccatggtttttacgtttcagagctatgctggaaacagc

SEQ ID NO: 57132 - DNA, 70 bp, Artificial Sequence
  Synthetic
gccaagcatttaggtgacactatagttccaagttctacagagcgagtttcagagctatgctggaaacagc

SEQ ID NO: 57133 - DNA, 70 bp, Artificial Sequence
  Synthetic
gccaagcatttaggtgacactatagaattcctttggcgctaaagagtttcagagctatgctggaaacagc

SEQ ID NO: 57134 - DNA, 70 bp, Artificial Sequence
  Synthetic
gccaagcatttaggtgacactatagggtggggaaagacttaaaaggtttcagagctatgctggaaacagc

SEQ ID NO: 57135 - DNA, 70 bp, Artificial Sequence
  Synthetic
gccaagcatttaggtgacactatagctcccagctgcccacctcatgtttcagagctatgctggaaacagc

SEQ ID NO: 57136 - DNA, 70 bp, Artificial Sequence
  Synthetic
gccaagcatttaggtgacactataggggccgtgatggtggggtgagtttcagagctatgctggaaacagc

SEQ ID NO: 57137 - DNA, 70 bp, Artificial Sequence
  Synthetic
gccaagcatttaggtgacactatagttcagttcgtttaacttgaggtttcagagctatgctggaaacagc

SEQ ID NO: 57138 - DNA, 70 bp, Artificial Sequence
  Synthetic
gccaagcatttaggtgacactataggttgtagggtctgctgtcaagtttcagagctatgctggaaacagc

SEQ ID NO: 57139 - DNA, 70 bp, Artificial Sequence
  Synthetic
gccaagcatttaggtgacactatagtgtagattctgtttcactccgtttcagagctatgctggaaacagc

SEQ ID NO: 57140 - DNA, 70 bp, Artificial Sequence
  Synthetic
gccaagcatttaggtgacactataggacccctgactgctactcctgtttcagagctatgctggaaacagc

SEQ ID NO: 57141 - DNA, 70 bp, Artificial Sequence
  Synthetic
gccaagcatttaggtgacactatagggcggcgtcggcggcgtcaggtttcagagctatgctggaaacagc

SEQ ID NO: 57142 - DNA, 70 bp, Artificial Sequence
  Synthetic
gccaagcatttaggtgacactatagcgggtgccagggctcaggccgtttcagagctatgctggaaacagc

SEQ ID NO: 57143 - DNA, 70 bp, Artificial Sequence
  Synthetic
gccaagcatttaggtgacactatagttctcagactcagtcagtcagtttcagagctatgctggaaacagc

SEQ ID NO: 57144 - DNA, 70 bp, Artificial Sequence
  Synthetic
gccaagcatttaggtgacactataggggccttggtctcaggcccagtttcagagctatgctggaaacagc

SEQ ID NO: 57145 - DNA, 70 bp, Artificial Sequence
  Synthetic
gccaagcatttaggtgacactatagttcttcggttttacttcctggtttcagagctatgctggaaacagc

SEQ ID NO: 57146 - DNA, 70 bp, Artificial Sequence
  Synthetic
gccaagcatttaggtgacactatagtggggctcaggagcgataaggtttcagagctatgctggaaacagc

SEQ ID NO: 57147 - DNA, 70 bp, Artificial Sequence
  Synthetic
gccaagcatttaggtgacactatagaaaaacgtctcacgacacaggtttcagagctatgctggaaacagc

SEQ ID NO: 57148 - DNA, 70 bp, Artificial Sequence
  Synthetic
gccaagcatttaggtgacactatagagctataaaagaagagcgcagtttcagagctatgctggaaacagc

SEQ ID NO: 57149 - DNA, 70 bp, Artificial Sequence
  Synthetic
gccaagcatttaggtgacactataggagacgggttcagatctcgcgtttcagagctatgctggaaacagc

SEQ ID NO: 57150 - DNA, 70 bp, Artificial Sequence
  Synthetic
gccaagcatttaggtgacactatagtgtatttcgcacttcggtccgtttcagagctatgctggaaacagc

SEQ ID NO: 57151 - DNA, 70 bp, Artificial Sequence
  Synthetic
gccaagcatttaggtgacactatagctctgaagagcgcgaagcaggtttcagagctatgctggaaacagc

SEQ ID NO: 57152 - DNA, 70 bp, Artificial Sequence
  Synthetic
gccaagcatttaggtgacactatagagacacaaacactgaatcgagtttcagagctatgctggaaacagc

SEQ ID NO: 57153 - DNA, 70 bp, Artificial Sequence
  Synthetic
gccaagcatttaggtgacactatagtggcgactatattacaaatggtttcagagctatgctggaaacagc

SEQ ID NO: 57154 - DNA, 70 bp, Artificial Sequence
  Synthetic
gccaagcatttaggtgacactatagagacattcatacatatccgggtttcagagctatgctggaaacagc

SEQ ID NO: 57155 - DNA, 70 bp, Artificial Sequence
  Synthetic
gccaagcatttaggtgacactatagacaagaaggtcacatcatccgtttcagagctatgctggaaacagc

SEQ ID NO: 57156 - DNA, 70 bp, Artificial Sequence
  Synthetic
gccaagcatttaggtgacactatagactacacaagcgtcctaaatgtttcagagctatgctggaaacagc

SEQ ID NO: 57157 - DNA, 70 bp, Artificial Sequence
  Synthetic
gccaagcatttaggtgacactataggccaaccaggccctgtgctggtttcagagctatgctggaaacagc

SEQ ID NO: 57158 - DNA, 70 bp, Artificial Sequence
  Synthetic
gccaagcatttaggtgacactatagattgaccagctttgaagggagtttcagagctatgctggaaacagc

SEQ ID NO: 57159 - DNA, 70 bp, Artificial Sequence
  Synthetic
gccaagcatttaggtgacactatagagacatcagagatactcaacgtttcagagctatgctggaaacagc

SEQ ID NO: 57160 - DNA, 70 bp, Artificial Sequence
  Synthetic
gccaagcatttaggtgacactatagtcagtccatccatccatcacgtttcagagctatgctggaaacagc

SEQ ID NO: 57161 - DNA, 70 bp, Artificial Sequence
  Synthetic
gccaagcatttaggtgacactatagccaggatagctgcgtggctagtttcagagctatgctggaaacagc

SEQ ID NO: 57162 - DNA, 70 bp, Artificial Sequence
  Synthetic
gccaagcatttaggtgacactatagtctgccaaaggaagtacaacgtttcagagctatgctggaaacagc

SEQ ID NO: 57163 - DNA, 70 bp, Artificial Sequence
  Synthetic
gccaagcatttaggtgacactatagttccctggggggaaggtcacgtttcagagctatgctggaaacagc

SEQ ID NO: 57164 - DNA, 70 bp, Artificial Sequence
  Synthetic
gccaagcatttaggtgacactataggacagggtctgggcggtcaggtttcagagctatgctggaaacagc

SEQ ID NO: 57165 - DNA, 70 bp, Artificial Sequence
  Synthetic
gccaagcatttaggtgacactatagttgcactgtggaattcaggagtttcagagctatgctggaaacagc

SEQ ID NO: 57166 - DNA, 70 bp, Artificial Sequence
  Synthetic
gccaagcatttaggtgacactataggcaatgaccctcaaaacagagtttcagagctatgctggaaacagc

SEQ ID NO: 57167 - DNA, 70 bp, Artificial Sequence
  Synthetic
gccaagcatttaggtgacactatagagtctcagtgcagcagccaggtttcagagctatgctggaaacagc

SEQ ID NO: 57168 - DNA, 70 bp, Artificial Sequence
  Synthetic
gccaagcatttaggtgacactatagctcttgccaggactgtggaggtttcagagctatgctggaaacagc

SEQ ID NO: 57169 - DNA, 70 bp, Artificial Sequence
  Synthetic
gccaagcatttaggtgacactatagcagatgtcaccaaaatcaccgtttcagagctatgctggaaacagc

SEQ ID NO: 57170 - DNA, 70 bp, Artificial Sequence
  Synthetic
gccaagcatttaggtgacactatagaggactgtggagcggatagggtttcagagctatgctggaaacagc

SEQ ID NO: 57171 - DNA, 70 bp, Artificial Sequence
  Synthetic
gccaagcatttaggtgacactatagggcctgccctcctctgggctgtttcagagctatgctggaaacagc

SEQ ID NO: 57172 - DNA, 70 bp, Artificial Sequence
  Synthetic
gccaagcatttaggtgacactatagagcgaattttacaacacttggtttcagagctatgctggaaacagc

SEQ ID NO: 57173 - DNA, 70 bp, Artificial Sequence
  Synthetic
gccaagcatttaggtgacactataggcagtcccgtggctcaagacgtttcagagctatgctggaaacagc

SEQ ID NO: 57174 - DNA, 70 bp, Artificial Sequence
  Synthetic
gccaagcatttaggtgacactatagttgactgtgcacctttgagcgtttcagagctatgctggaaacagc

SEQ ID NO: 57175 - DNA, 70 bp, Artificial Sequence
  Synthetic
gccaagcatttaggtgacactatagtcatcagttcgatatgcacagtttcagagctatgctggaaacagc

SEQ ID NO: 57176 - DNA, 70 bp, Artificial Sequence
  Synthetic
gccaagcatttaggtgacactatagggagcacatgatagtagcatgtttcagagctatgctggaaacagc

SEQ ID NO: 57177 - DNA, 70 bp, Artificial Sequence
  Synthetic
gccaagcatttaggtgacactatagtgtgagcgtgcgggagggctgtttcagagctatgctggaaacagc

SEQ ID NO: 57178 - DNA, 70 bp, Artificial Sequence
  Synthetic
gccaagcatttaggtgacactatagttttcataggtaggactttcgtttcagagctatgctggaaacagc

SEQ ID NO: 57179 - DNA, 70 bp, Artificial Sequence
  Synthetic
gccaagcatttaggtgacactatagagaagaaatgctcttttgctgtttcagagctatgctggaaacagc

SEQ ID NO: 57180 - DNA, 70 bp, Artificial Sequence
  Synthetic
gccaagcatttaggtgacactatagcagatccgaagaggaactccgtttcagagctatgctggaaacagc

SEQ ID NO: 57181 - DNA, 70 bp, Artificial Sequence
  Synthetic
gccaagcatttaggtgacactataggccaagtacctcaagagacagtttcagagctatgctggaaacagc

SEQ ID NO: 57182 - DNA, 70 bp, Artificial Sequence
  Synthetic
gccaagcatttaggtgacactatagaagtcattgtctatgtccgagtttcagagctatgctggaaacagc

SEQ ID NO: 57183 - DNA, 70 bp, Artificial Sequence
  Synthetic
gccaagcatttaggtgacactatagccgctttgagcccagaggtggtttcagagctatgctggaaacagc

SEQ ID NO: 57184 - DNA, 70 bp, Artificial Sequence
  Synthetic
gccaagcatttaggtgacactatagctgtgctctaaggctgctgcgtttcagagctatgctggaaacagc

SEQ ID NO: 57185 - DNA, 70 bp, Artificial Sequence
  Synthetic
gccaagcatttaggtgacactataggcctctgcaaccatgactgagtttcagagctatgctggaaacagc

SEQ ID NO: 57186 - DNA, 70 bp, Artificial Sequence
  Synthetic
gccaagcatttaggtgacactatagcatctctcatgaaggcgattgtttcagagctatgctggaaacagc

SEQ ID NO: 57187 - DNA, 70 bp, Artificial Sequence
  Synthetic
gccaagcatttaggtgacactatagctgggcagacacgagcaggagtttcagagctatgctggaaacagc

SEQ ID NO: 57188 - DNA, 70 bp, Artificial Sequence
  Synthetic
gccaagcatttaggtgacactatagtcagctggaattcttcacacgtttcagagctatgctggaaacagc

SEQ ID NO: 57189 - DNA, 70 bp, Artificial Sequence
  Synthetic
gccaagcatttaggtgacactatagttcagcagtgtgccgagaaggtttcagagctatgctggaaacagc

SEQ ID NO: 57190 - DNA, 70 bp, Artificial Sequence
  Synthetic
gccaagcatttaggtgacactataggtgggcggggactctacagtgtttcagagctatgctggaaacagc

SEQ ID NO: 57191 - DNA, 70 bp, Artificial Sequence
  Synthetic
gccaagcatttaggtgacactatagcaggtggagaagctcacagtgtttcagagctatgctggaaacagc

SEQ ID NO: 57192 - DNA, 70 bp, Artificial Sequence
  Synthetic
gccaagcatttaggtgacactataggctagatggtcagtccctgagtttcagagctatgctggaaacagc

SEQ ID NO: 57193 - DNA, 70 bp, Artificial Sequence
  Synthetic
gccaagcatttaggtgacactatagtcccagtcctcctgctggtggtttcagagctatgctggaaacagc

SEQ ID NO: 57194 - DNA, 70 bp, Artificial Sequence
  Synthetic
gccaagcatttaggtgacactatagggttagggctcatgttataggtttcagagctatgctggaaacagc

SEQ ID NO: 57195 - DNA, 70 bp, Artificial Sequence
  Synthetic
gccaagcatttaggtgacactataggaatggtggcatcacagcaagtttcagagctatgctggaaacagc

SEQ ID NO: 57196 - DNA, 70 bp, Artificial Sequence
  Synthetic
gccaagcatttaggtgacactatagcttcggggactgctgccctggtttcagagctatgctggaaacagc

SEQ ID NO: 57197 - DNA, 70 bp, Artificial Sequence
  Synthetic
gccaagcatttaggtgacactatagtcttagtgacgtcaatcaatgtttcagagctatgctggaaacagc

SEQ ID NO: 57198 - DNA, 70 bp, Artificial Sequence
  Synthetic
gccaagcatttaggtgacactataggggccagcgactagttagacgtttcagagctatgctggaaacagc

SEQ ID NO: 57199 - DNA, 70 bp, Artificial Sequence
  Synthetic
gccaagcatttaggtgacactatagtacaaagctgccaggagaaagtttcagagctatgctggaaacagc

SEQ ID NO: 57200 - DNA, 70 bp, Artificial Sequence
  Synthetic
gccaagcatttaggtgacactatagtcatgagatctgagatatacgtttcagagctatgctggaaacagc

SEQ ID NO: 57201 - DNA, 70 bp, Artificial Sequence
  Synthetic
gccaagcatttaggtgacactatagtcaaggcaatatgcagctcagtttcagagctatgctggaaacagc

SEQ ID NO: 57202 - DNA, 70 bp, Artificial Sequence
  Synthetic
gccaagcatttaggtgacactatagccctgcacaagttggccttggtttcagagctatgctggaaacagc

SEQ ID NO: 57203 - DNA, 70 bp, Artificial Sequence
  Synthetic
gccaagcatttaggtgacactatagccttggagtaattcgtcgacgtttcagagctatgctggaaacagc

SEQ ID NO: 57204 - DNA, 70 bp, Artificial Sequence
  Synthetic
gccaagcatttaggtgacactatagcgttccaatgcactccagccgtttcagagctatgctggaaacagc

SEQ ID NO: 57205 - DNA, 70 bp, Artificial Sequence
  Synthetic
gccaagcatttaggtgacactataggtccccggcttgctaggtccgtttcagagctatgctggaaacagc

SEQ ID NO: 57206 - DNA, 70 bp, Artificial Sequence
  Synthetic
gccaagcatttaggtgacactatagttgatgtattctgacgtcatgtttcagagctatgctggaaacagc

SEQ ID NO: 57207 - DNA, 70 bp, Artificial Sequence
  Synthetic
gccaagcatttaggtgacactatagaaaactcattgcttctgagtgtttcagagctatgctggaaacagc

SEQ ID NO: 57208 - DNA, 70 bp, Artificial Sequence
  Synthetic
gccaagcatttaggtgacactataggtgtgtgtgtgtgtgtaagcgtttcagagctatgctggaaacagc

SEQ ID NO: 57209 - DNA, 70 bp, Artificial Sequence
  Synthetic
gccaagcatttaggtgacactatagcaaacactagttcatccctggtttcagagctatgctggaaacagc

SEQ ID NO: 57210 - DNA, 70 bp, Artificial Sequence
  Synthetic
gccaagcatttaggtgacactataggtttgaagatttcatcctccgtttcagagctatgctggaaacagc

SEQ ID NO: 57211 - DNA, 70 bp, Artificial Sequence
  Synthetic
gccaagcatttaggtgacactatagaacttccctctatcacagttgtttcagagctatgctggaaacagc

SEQ ID NO: 57212 - DNA, 70 bp, Artificial Sequence
  Synthetic
gccaagcatttaggtgacactatagtaagcaagagaatcattagcgtttcagagctatgctggaaacagc

SEQ ID NO: 57213 - DNA, 70 bp, Artificial Sequence
  Synthetic
gccaagcatttaggtgacactatagtcagtcacctgctgctcaacgtttcagagctatgctggaaacagc

SEQ ID NO: 57214 - DNA, 70 bp, Artificial Sequence
  Synthetic
gccaagcatttaggtgacactatagacaaagcttagctccccgctgtttcagagctatgctggaaacagc

SEQ ID NO: 57215 - DNA, 70 bp, Artificial Sequence
  Synthetic
gccaagcatttaggtgacactataggaagttcattcgcattcaccgtttcagagctatgctggaaacagc

SEQ ID NO: 57216 - DNA, 70 bp, Artificial Sequence
  Synthetic
gccaagcatttaggtgacactatagtcatctaaacttcagcttccgtttcagagctatgctggaaacagc

SEQ ID NO: 57217 - DNA, 70 bp, Artificial Sequence
  Synthetic
gccaagcatttaggtgacactatagcgtcagtatgttcaaggttggtttcagagctatgctggaaacagc

SEQ ID NO: 57218 - DNA, 70 bp, Artificial Sequence
  Synthetic
gccaagcatttaggtgacactatagggctgtgaggtttcctaaacgtttcagagctatgctggaaacagc

SEQ ID NO: 57219 - DNA, 70 bp, Artificial Sequence
  Synthetic
gccaagcatttaggtgacactataggactgtgaggtttcctaaacgtttcagagctatgctggaaacagc

SEQ ID NO: 57220 - DNA, 70 bp, Artificial Sequence
  Synthetic
gccaagcatttaggtgacactatagaccctggcacggtggctggagtttcagagctatgctggaaacagc

SEQ ID NO: 57221 - DNA, 70 bp, Artificial Sequence
  Synthetic
gccaagcatttaggtgacactatagcccgcaccctgtttcatctcgtttcagagctatgctggaaacagc

SEQ ID NO: 57222 - DNA, 70 bp, Artificial Sequence
  Synthetic
gccaagcatttaggtgacactataggcagttacgcatgtattcacgtttcagagctatgctggaaacagc

SEQ ID NO: 57223 - DNA, 70 bp, Artificial Sequence
  Synthetic
gccaagcatttaggtgacactatagtcttgctctggcaagttttggtttcagagctatgctggaaacagc

SEQ ID NO: 57224 - DNA, 70 bp, Artificial Sequence
  Synthetic
gccaagcatttaggtgacactatagcaaagatctgaggaaaagacgtttcagagctatgctggaaacagc

SEQ ID NO: 57225 - DNA, 70 bp, Artificial Sequence
  Synthetic
gccaagcatttaggtgacactatagggttcaggagcagctgcacagtttcagagctatgctggaaacagc

SEQ ID NO: 57226 - DNA, 70 bp, Artificial Sequence
  Synthetic
gccaagcatttaggtgacactataggagctgggcgccgacatctggtttcagagctatgctggaaacagc

SEQ ID NO: 57227 - DNA, 70 bp, Artificial Sequence
  Synthetic
gccaagcatttaggtgacactatagcatagccactgagatctgaggtttcagagctatgctggaaacagc

SEQ ID NO: 57228 - DNA, 70 bp, Artificial Sequence
  Synthetic
gccaagcatttaggtgacactatagatcactgctactgagatctagtttcagagctatgctggaaacagc

SEQ ID NO: 57229 - DNA, 70 bp, Artificial Sequence
  Synthetic
gccaagcatttaggtgacactatagccaggtcgatcagatttctggtttcagagctatgctggaaacagc

SEQ ID NO: 57230 - DNA, 70 bp, Artificial Sequence
  Synthetic
gccaagcatttaggtgacactatagaacgattcttctttttcaccgtttcagagctatgctggaaacagc

SEQ ID NO: 57231 - DNA, 70 bp, Artificial Sequence
  Synthetic
gccaagcatttaggtgacactataggctggtgacttagggccttggtttcagagctatgctggaaacagc

SEQ ID NO: 57232 - DNA, 70 bp, Artificial Sequence
  Synthetic
gccaagcatttaggtgacactataggggggaggagtcagaagaaagtttcagagctatgctggaaacagc

SEQ ID NO: 57233 - DNA, 70 bp, Artificial Sequence
  Synthetic
gccaagcatttaggtgacactatagaagtaacatggcagcatttggtttcagagctatgctggaaacagc

SEQ ID NO: 57234 - DNA, 70 bp, Artificial Sequence
  Synthetic
gccaagcatttaggtgacactatagcctgaccaacccgaaaagttgtttcagagctatgctggaaacagc

SEQ ID NO: 57235 - DNA, 70 bp, Artificial Sequence
  Synthetic
gccaagcatttaggtgacactatagaaaagcctggacaaactatagtttcagagctatgctggaaacagc

SEQ ID NO: 57236 - DNA, 70 bp, Artificial Sequence
  Synthetic
gccaagcatttaggtgacactatagcccagatcggcccgccctgagtttcagagctatgctggaaacagc

SEQ ID NO: 57237 - DNA, 70 bp, Artificial Sequence
  Synthetic
gccaagcatttaggtgacactatagaactgcattctccacttctggtttcagagctatgctggaaacagc

SEQ ID NO: 57238 - DNA, 70 bp, Artificial Sequence
  Synthetic
gccaagcatttaggtgacactataggcttagacagtgttatcgctgtttcagagctatgctggaaacagc

SEQ ID NO: 57239 - DNA, 70 bp, Artificial Sequence
  Synthetic
gccaagcatttaggtgacactataggctcccccactacttccccggtttcagagctatgctggaaacagc

SEQ ID NO: 57240 - DNA, 70 bp, Artificial Sequence
  Synthetic
gccaagcatttaggtgacactataggaagcgaaggaacaaagaaagtttcagagctatgctggaaacagc

SEQ ID NO: 57241 - DNA, 70 bp, Artificial Sequence
  Synthetic
gccaagcatttaggtgacactatagcgagcctgcaggctacgccagtttcagagctatgctggaaacagc

SEQ ID NO: 57242 - DNA, 70 bp, Artificial Sequence
  Synthetic
gccaagcatttaggtgacactatagaaaattcctgtcaatgactggtttcagagctatgctggaaacagc

SEQ ID NO: 57243 - DNA, 70 bp, Artificial Sequence
  Synthetic
gccaagcatttaggtgacactatagaagaagcactcattcactcggtttcagagctatgctggaaacagc

SEQ ID NO: 57244 - DNA, 70 bp, Artificial Sequence
  Synthetic
gccaagcatttaggtgacactataggctcataaaggcagctgagggtttcagagctatgctggaaacagc

SEQ ID NO: 57245 - DNA, 70 bp, Artificial Sequence
  Synthetic
gccaagcatttaggtgacactatagcgggatcagcccctcctgaggtttcagagctatgctggaaacagc

SEQ ID NO: 57246 - DNA, 70 bp, Artificial Sequence
  Synthetic
gccaagcatttaggtgacactatagatttgaggttgatcccttccgtttcagagctatgctggaaacagc

SEQ ID NO: 57247 - DNA, 70 bp, Artificial Sequence
  Synthetic
gccaagcatttaggtgacactatagcccggcctgtctctagctgagtttcagagctatgctggaaacagc

SEQ ID NO: 57248 - DNA, 70 bp, Artificial Sequence
  Synthetic
gccaagcatttaggtgacactatagcgagaaggtgtacatcatgtgtttcagagctatgctggaaacagc

SEQ ID NO: 57249 - DNA, 70 bp, Artificial Sequence
  Synthetic
gccaagcatttaggtgacactatagccttacatgtcccaaaaagagtttcagagctatgctggaaacagc

SEQ ID NO: 57250 - DNA, 70 bp, Artificial Sequence
  Synthetic
gccaagcatttaggtgacactatagcactggtaagtacacgatgcgtttcagagctatgctggaaacagc

SEQ ID NO: 57251 - DNA, 70 bp, Artificial Sequence
  Synthetic
gccaagcatttaggtgacactatagtcagactcacatgaaaaactgtttcagagctatgctggaaacagc

SEQ ID NO: 57252 - DNA, 70 bp, Artificial Sequence
  Synthetic
gccaagcatttaggtgacactatagccagtgatctgtatttgatggtttcagagctatgctggaaacagc

SEQ ID NO: 57253 - DNA, 70 bp, Artificial Sequence
  Synthetic
gccaagcatttaggtgacactataggctcggggtccggcgcctacgtttcagagctatgctggaaacagc

SEQ ID NO: 57254 - DNA, 70 bp, Artificial Sequence
  Synthetic
gccaagcatttaggtgacactatagcacgactcacagaaagaactgtttcagagctatgctggaaacagc

SEQ ID NO: 57255 - DNA, 70 bp, Artificial Sequence
  Synthetic
gccaagcatttaggtgacactatagcgggggcgggcactaggagcgtttcagagctatgctggaaacagc

SEQ ID NO: 57256 - DNA, 70 bp, Artificial Sequence
  Synthetic
gccaagcatttaggtgacactatagggcacaccaggccaaactatgtttcagagctatgctggaaacagc

SEQ ID NO: 57257 - DNA, 70 bp, Artificial Sequence
  Synthetic
gccaagcatttaggtgacactataggggcaggaccaggatgcagcgtttcagagctatgctggaaacagc

SEQ ID NO: 57258 - DNA, 70 bp, Artificial Sequence
  Synthetic
gccaagcatttaggtgacactatagggggcactcagtgagattccgtttcagagctatgctggaaacagc

SEQ ID NO: 57259 - DNA, 70 bp, Artificial Sequence
  Synthetic
gccaagcatttaggtgacactatagctgaaatccgggtcaagtgagtttcagagctatgctggaaacagc

SEQ ID NO: 57260 - DNA, 70 bp, Artificial Sequence
  Synthetic
gccaagcatttaggtgacactataggctttgagagaggaggaagagtttcagagctatgctggaaacagc

SEQ ID NO: 57261 - DNA, 70 bp, Artificial Sequence
  Synthetic
gccaagcatttaggtgacactatagtgtcttactttattcagggtgtttcagagctatgctggaaacagc

SEQ ID NO: 57262 - DNA, 70 bp, Artificial Sequence
  Synthetic
gccaagcatttaggtgacactataggctttgagagaggagggagagtttcagagctatgctggaaacagc

SEQ ID NO: 57263 - DNA, 70 bp, Artificial Sequence
  Synthetic
gccaagcatttaggtgacactatagtgaatgggcttttagagagggtttcagagctatgctggaaacagc

SEQ ID NO: 57264 - DNA, 70 bp, Artificial Sequence
  Synthetic
gccaagcatttaggtgacactatagcatgaacgggctttgagagagtttcagagctatgctggaaacagc

SEQ ID NO: 57265 - DNA, 70 bp, Artificial Sequence
  Synthetic
gccaagcatttaggtgacactatagtgagtgggttttgagagagggtttcagagctatgctggaaacagc

SEQ ID NO: 57266 - DNA, 70 bp, Artificial Sequence
  Synthetic
gccaagcatttaggtgacactataggctttgttagaggaggaagagtttcagagctatgctggaaacagc

SEQ ID NO: 57267 - DNA, 70 bp, Artificial Sequence
  Synthetic
gccaagcatttaggtgacactataggctccttgacttaatacttggtttcagagctatgctggaaacagc

SEQ ID NO: 57268 - DNA, 70 bp, Artificial Sequence
  Synthetic
gccaagcatttaggtgacactatagtgagtgggctttgagagagggtttcagagctatgctggaaacagc

SEQ ID NO: 57269 - DNA, 70 bp, Artificial Sequence
  Synthetic
gccaagcatttaggtgacactataggaggagaaaggagtttgagcgtttcagagctatgctggaaacagc

SEQ ID NO: 57270 - DNA, 70 bp, Artificial Sequence
  Synthetic
gccaagcatttaggtgacactataggttttgggagaggagcaagagtttcagagctatgctggaaacagc

SEQ ID NO: 57271 - DNA, 70 bp, Artificial Sequence
  Synthetic
gccaagcatttaggtgacactatagaatctgcctgagttctcacagtttcagagctatgctggaaacagc

SEQ ID NO: 57272 - DNA, 70 bp, Artificial Sequence
  Synthetic
gccaagcatttaggtgacactatagccctcagactttactgcagtgtttcagagctatgctggaaacagc

SEQ ID NO: 57273 - DNA, 70 bp, Artificial Sequence
  Synthetic
gccaagcatttaggtgacactataggtcagccctgactcaaattcgtttcagagctatgctggaaacagc

SEQ ID NO: 57274 - DNA, 70 bp, Artificial Sequence
  Synthetic
gccaagcatttaggtgacactataggcgccagggccagggctagcgtttcagagctatgctggaaacagc

SEQ ID NO: 57275 - DNA, 70 bp, Artificial Sequence
  Synthetic
gccaagcatttaggtgacactataggcctcagatttcacttagcagtttcagagctatgctggaaacagc

SEQ ID NO: 57276 - DNA, 70 bp, Artificial Sequence
  Synthetic
gccaagcatttaggtgacactatagtacaactctggctcagactcgtttcagagctatgctggaaacagc

SEQ ID NO: 57277 - DNA, 70 bp, Artificial Sequence
  Synthetic
gccaagcatttaggtgacactatagtgcttcaacttcactaggcggtttcagagctatgctggaaacagc

SEQ ID NO: 57278 - DNA, 70 bp, Artificial Sequence
  Synthetic
gccaagcatttaggtgacactatagaatttgccttagatctcacagtttcagagctatgctggaaacagc

SEQ ID NO: 57279 - DNA, 70 bp, Artificial Sequence
  Synthetic
gccaagcatttaggtgacactatagcagtggccaagactgtctcagtttcagagctatgctggaaacagc

SEQ ID NO: 57280 - DNA, 70 bp, Artificial Sequence
  Synthetic
gccaagcatttaggtgacactataggcattgagactgagagcttagtttcagagctatgctggaaacagc

SEQ ID NO: 57281 - DNA, 70 bp, Artificial Sequence
  Synthetic
gccaagcatttaggtgacactatagacttcactcagaagagaagcgtttcagagctatgctggaaacagc

SEQ ID NO: 57282 - DNA, 70 bp, Artificial Sequence
  Synthetic
gccaagcatttaggtgacactatagtcctagacttcactcagaaagtttcagagctatgctggaaacagc

SEQ ID NO: 57283 - DNA, 70 bp, Artificial Sequence
  Synthetic
gccaagcatttaggtgacactatagaaaggcactagggatgatacgtttcagagctatgctggaaacagc

SEQ ID NO: 57284 - DNA, 70 bp, Artificial Sequence
  Synthetic
gccaagcatttaggtgacactataggaagttggtggacatgacacgtttcagagctatgctggaaacagc

SEQ ID NO: 57285 - DNA, 70 bp, Artificial Sequence
  Synthetic
gccaagcatttaggtgacactatagtggtgccattggtttcttctgtttcagagctatgctggaaacagc

SEQ ID NO: 57286 - DNA, 70 bp, Artificial Sequence
  Synthetic
gccaagcatttaggtgacactatagtcacttgtaggagaaaccacgtttcagagctatgctggaaacagc

SEQ ID NO: 57287 - DNA, 70 bp, Artificial Sequence
  Synthetic
gccaagcatttaggtgacactatagagatcgctgcagttcgtcaagtttcagagctatgctggaaacagc

SEQ ID NO: 57288 - DNA, 70 bp, Artificial Sequence
  Synthetic
gccaagcatttaggtgacactatagccgaaactcttactggatccgtttcagagctatgctggaaacagc

SEQ ID NO: 57289 - DNA, 70 bp, Artificial Sequence
  Synthetic
gccaagcatttaggtgacactatagttgttcacaacttcaggtaggtttcagagctatgctggaaacagc

SEQ ID NO: 57290 - DNA, 70 bp, Artificial Sequence
  Synthetic
gccaagcatttaggtgacactatagcatattccctagacttcacggtttcagagctatgctggaaacagc

SEQ ID NO: 57291 - DNA, 70 bp, Artificial Sequence
  Synthetic
gccaagcatttaggtgacactatagccggcatccacctctggtgagtttcagagctatgctggaaacagc

SEQ ID NO: 57292 - DNA, 70 bp, Artificial Sequence
  Synthetic
gccaagcatttaggtgacactatagtctgcctcagatctacttaagtttcagagctatgctggaaacagc

SEQ ID NO: 57293 - DNA, 70 bp, Artificial Sequence
  Synthetic
gccaagcatttaggtgacactatagatctctgctacacctattaggtttcagagctatgctggaaacagc

SEQ ID NO: 57294 - DNA, 70 bp, Artificial Sequence
  Synthetic
gccaagcatttaggtgacactatagacaaggtgttccggaagtgagtttcagagctatgctggaaacagc

SEQ ID NO: 57295 - DNA, 70 bp, Artificial Sequence
  Synthetic
gccaagcatttaggtgacactatagactcagcgtctcagatactggtttcagagctatgctggaaacagc

SEQ ID NO: 57296 - DNA, 70 bp, Artificial Sequence
  Synthetic
gccaagcatttaggtgacactatagcaaattcatggagtcatgccgtttcagagctatgctggaaacagc

SEQ ID NO: 57297 - DNA, 70 bp, Artificial Sequence
  Synthetic
gccaagcatttaggtgacactatagtggccgcgcggctcatctgcgtttcagagctatgctggaaacagc

SEQ ID NO: 57298 - DNA, 70 bp, Artificial Sequence
  Synthetic
gccaagcatttaggtgacactatagctattggtatggctgagaaagtttcagagctatgctggaaacagc

SEQ ID NO: 57299 - DNA, 70 bp, Artificial Sequence
  Synthetic
gccaagcatttaggtgacactataggtgaaacccgagcaacattagtttcagagctatgctggaaacagc

SEQ ID NO: 57300 - DNA, 70 bp, Artificial Sequence
  Synthetic
gccaagcatttaggtgacactatagggctcagtgtctccgccttcgtttcagagctatgctggaaacagc

SEQ ID NO: 57301 - DNA, 70 bp, Artificial Sequence
  Synthetic
gccaagcatttaggtgacactatagtgtttggtcttcagtcttatgtttcagagctatgctggaaacagc

SEQ ID NO: 57302 - DNA, 70 bp, Artificial Sequence
  Synthetic
gccaagcatttaggtgacactatagtaaaatactcgaaggccttcgtttcagagctatgctggaaacagc

SEQ ID NO: 57303 - DNA, 70 bp, Artificial Sequence
  Synthetic
gccaagcatttaggtgacactataggctacctctgacatggatatgtttcagagctatgctggaaacagc

SEQ ID NO: 57304 - DNA, 70 bp, Artificial Sequence
  Synthetic
gccaagcatttaggtgacactatagtgagtgttcaatccgtgcaagtttcagagctatgctggaaacagc

SEQ ID NO: 57305 - DNA, 70 bp, Artificial Sequence
  Synthetic
gccaagcatttaggtgacactataggagcagccaccggcttctttgtttcagagctatgctggaaacagc

SEQ ID NO: 57306 - DNA, 70 bp, Artificial Sequence
  Synthetic
gccaagcatttaggtgacactataggcatttggaaggctcaagaggtttcagagctatgctggaaacagc

SEQ ID NO: 57307 - DNA, 70 bp, Artificial Sequence
  Synthetic
gccaagcatttaggtgacactatagttcacaccatagactcctacgtttcagagctatgctggaaacagc

SEQ ID NO: 57308 - DNA, 70 bp, Artificial Sequence
  Synthetic
gccaagcatttaggtgacactatagatgctgaaagggaaatcacggtttcagagctatgctggaaacagc

SEQ ID NO: 57309 - DNA, 70 bp, Artificial Sequence
  Synthetic
gccaagcatttaggtgacactatagagggttatcgtcttccaccagtttcagagctatgctggaaacagc

SEQ ID NO: 57310 - DNA, 70 bp, Artificial Sequence
  Synthetic
gccaagcatttaggtgacactatagcggtgttctctttaatcagagtttcagagctatgctggaaacagc

SEQ ID NO: 57311 - DNA, 70 bp, Artificial Sequence
  Synthetic
gccaagcatttaggtgacactatagtgggtctggctttacgaagagtttcagagctatgctggaaacagc

SEQ ID NO: 57312 - DNA, 70 bp, Artificial Sequence
  Synthetic
gccaagcatttaggtgacactataggcctggcgcctgtgcatcaggtttcagagctatgctggaaacagc

SEQ ID NO: 57313 - DNA, 70 bp, Artificial Sequence
  Synthetic
gccaagcatttaggtgacactataggctatttgagatgatgtgacgtttcagagctatgctggaaacagc

SEQ ID NO: 57314 - DNA, 70 bp, Artificial Sequence
  Synthetic
gccaagcatttaggtgacactatagtacttcatctgtgactccaggtttcagagctatgctggaaacagc

SEQ ID NO: 57315 - DNA, 70 bp, Artificial Sequence
  Synthetic
gccaagcatttaggtgacactatagtaccatttagtttctctgacgtttcagagctatgctggaaacagc

SEQ ID NO: 57316 - DNA, 70 bp, Artificial Sequence
  Synthetic
gccaagcatttaggtgacactatagacaatcatcaggatattctggtttcagagctatgctggaaacagc

SEQ ID NO: 57317 - DNA, 70 bp, Artificial Sequence
  Synthetic
gccaagcatttaggtgacactatagccaaggagagaaatttcagagtttcagagctatgctggaaacagc

SEQ ID NO: 57318 - DNA, 70 bp, Artificial Sequence
  Synthetic
gccaagcatttaggtgacactatagtggggtggtctacggatcacgtttcagagctatgctggaaacagc

SEQ ID NO: 57319 - DNA, 70 bp, Artificial Sequence
  Synthetic
gccaagcatttaggtgacactatagacctgttagggtctcagtaagtttcagagctatgctggaaacagc

SEQ ID NO: 57320 - DNA, 70 bp, Artificial Sequence
  Synthetic
gccaagcatttaggtgacactatagcagagcctggtaatgatgacgtttcagagctatgctggaaacagc

SEQ ID NO: 57321 - DNA, 70 bp, Artificial Sequence
  Synthetic
gccaagcatttaggtgacactatagttggggcctctcttgattaggtttcagagctatgctggaaacagc

SEQ ID NO: 57322 - DNA, 70 bp, Artificial Sequence
  Synthetic
gccaagcatttaggtgacactataggcaagtcacccaggatgctggtttcagagctatgctggaaacagc

SEQ ID NO: 57323 - DNA, 70 bp, Artificial Sequence
  Synthetic
gccaagcatttaggtgacactatagatatgcattctgccgttcaggtttcagagctatgctggaaacagc

SEQ ID NO: 57324 - DNA, 70 bp, Artificial Sequence
  Synthetic
gccaagcatttaggtgacactatagtgctggaggatccatggtgagtttcagagctatgctggaaacagc

SEQ ID NO: 57325 - DNA, 70 bp, Artificial Sequence
  Synthetic
gccaagcatttaggtgacactatagaaaggaagttgaaatcagaggtttcagagctatgctggaaacagc

SEQ ID NO: 57326 - DNA, 70 bp, Artificial Sequence
  Synthetic
gccaagcatttaggtgacactatagaactgctttcatcgaacagcgtttcagagctatgctggaaacagc

SEQ ID NO: 57327 - DNA, 70 bp, Artificial Sequence
  Synthetic
gccaagcatttaggtgacactatagatctggacccctgcctaggggtttcagagctatgctggaaacagc

SEQ ID NO: 57328 - DNA, 70 bp, Artificial Sequence
  Synthetic
gccaagcatttaggtgacactataggcagcagagcttctttctaggtttcagagctatgctggaaacagc

SEQ ID NO: 57329 - DNA, 70 bp, Artificial Sequence
  Synthetic
gccaagcatttaggtgacactatagatggggtcagtgtctgccccgtttcagagctatgctggaaacagc

SEQ ID NO: 57330 - DNA, 70 bp, Artificial Sequence
  Synthetic
gccaagcatttaggtgacactatagaaagtcaggttcacctcaacgtttcagagctatgctggaaacagc

SEQ ID NO: 57331 - DNA, 70 bp, Artificial Sequence
  Synthetic
gccaagcatttaggtgacactatagtttcgcctccgcttgggttagtttcagagctatgctggaaacagc

SEQ ID NO: 57332 - DNA, 70 bp, Artificial Sequence
  Synthetic
gccaagcatttaggtgacactatagatggaaggaggtggatggttgtttcagagctatgctggaaacagc

SEQ ID NO: 57333 - DNA, 70 bp, Artificial Sequence
  Synthetic
gccaagcatttaggtgacactatagccgtccacccaaaggaaatcgtttcagagctatgctggaaacagc

SEQ ID NO: 57334 - DNA, 70 bp, Artificial Sequence
  Synthetic
gccaagcatttaggtgacactatagccagccccagggactcagtggtttcagagctatgctggaaacagc

SEQ ID NO: 57335 - DNA, 70 bp, Artificial Sequence
  Synthetic
gccaagcatttaggtgacactataggcccaccagcaagaatgagtgtttcagagctatgctggaaacagc

SEQ ID NO: 57336 - DNA, 70 bp, Artificial Sequence
  Synthetic
gccaagcatttaggtgacactatagagaaagagactaagaagaaggtttcagagctatgctggaaacagc

SEQ ID NO: 57337 - DNA, 70 bp, Artificial Sequence
  Synthetic
gccaagcatttaggtgacactatagtgcattaagaaacaggcagcgtttcagagctatgctggaaacagc

SEQ ID NO: 57338 - DNA, 70 bp, Artificial Sequence
  Synthetic
gccaagcatttaggtgacactatagcatgtacagtgatgtcatccgtttcagagctatgctggaaacagc

SEQ ID NO: 57339 - DNA, 70 bp, Artificial Sequence
  Synthetic
gccaagcatttaggtgacactatagggagcagtggctcatgtgaggtttcagagctatgctggaaacagc

SEQ ID NO: 57340 - DNA, 70 bp, Artificial Sequence
  Synthetic
gccaagcatttaggtgacactatagagattgagcagactacaaatgtttcagagctatgctggaaacagc

SEQ ID NO: 57341 - DNA, 70 bp, Artificial Sequence
  Synthetic
gccaagcatttaggtgacactataggggatctatgtggacatctagtttcagagctatgctggaaacagc

SEQ ID NO: 57342 - DNA, 70 bp, Artificial Sequence
  Synthetic
gccaagcatttaggtgacactatagatgaagagttctccttcatagtttcagagctatgctggaaacagc

SEQ ID NO: 57343 - DNA, 70 bp, Artificial Sequence
  Synthetic
gccaagcatttaggtgacactatagagaacagaacttcaagaccggtttcagagctatgctggaaacagc

SEQ ID NO: 57344 - DNA, 70 bp, Artificial Sequence
  Synthetic
gccaagcatttaggtgacactataggacccttctatcaactccccgtttcagagctatgctggaaacagc

SEQ ID NO: 57345 - DNA, 70 bp, Artificial Sequence
  Synthetic
gccaagcatttaggtgacactataggcttcctggcccacaaaagggtttcagagctatgctggaaacagc

SEQ ID NO: 57346 - DNA, 70 bp, Artificial Sequence
  Synthetic
gccaagcatttaggtgacactataggaagaaggcaatgatgatgtgtttcagagctatgctggaaacagc

SEQ ID NO: 57347 - DNA, 70 bp, Artificial Sequence
  Synthetic
gccaagcatttaggtgacactatagctttcagaactcaatcttgcgtttcagagctatgctggaaacagc

SEQ ID NO: 57348 - DNA, 70 bp, Artificial Sequence
  Synthetic
gccaagcatttaggtgacactatagtacagttcaatcttgcatgcgtttcagagctatgctggaaacagc

SEQ ID NO: 57349 - DNA, 70 bp, Artificial Sequence
  Synthetic
gccaagcatttaggtgacactatagactgctggctcagaagccgagtttcagagctatgctggaaacagc

SEQ ID NO: 57350 - DNA, 70 bp, Artificial Sequence
  Synthetic
gccaagcatttaggtgacactatagatgcctcccaggagacgttcgtttcagagctatgctggaaacagc

SEQ ID NO: 57351 - DNA, 70 bp, Artificial Sequence
  Synthetic
gccaagcatttaggtgacactataggtgcctcccaggagacgttcgtttcagagctatgctggaaacagc

SEQ ID NO: 57352 - DNA, 70 bp, Artificial Sequence
  Synthetic
gccaagcatttaggtgacactatagcttcccgacatgggctagaggtttcagagctatgctggaaacagc

SEQ ID NO: 57353 - DNA, 70 bp, Artificial Sequence
  Synthetic
gccaagcatttaggtgacactatagcgccttcccggcctgcaagggtttcagagctatgctggaaacagc

SEQ ID NO: 57354 - DNA, 70 bp, Artificial Sequence
  Synthetic
gccaagcatttaggtgacactatagactgctgcactcgctaagcagtttcagagctatgctggaaacagc

SEQ ID NO: 57355 - DNA, 70 bp, Artificial Sequence
  Synthetic
gccaagcatttaggtgacactatagagcacaccaacccatgctgcgtttcagagctatgctggaaacagc

SEQ ID NO: 57356 - DNA, 70 bp, Artificial Sequence
  Synthetic
gccaagcatttaggtgacactatagggagcccggccactgtcacagtttcagagctatgctggaaacagc

SEQ ID NO: 57357 - DNA, 70 bp, Artificial Sequence
  Synthetic
gccaagcatttaggtgacactatagtcctgggagaagactcataggtttcagagctatgctggaaacagc

SEQ ID NO: 57358 - DNA, 70 bp, Artificial Sequence
  Synthetic
gccaagcatttaggtgacactataggcgatatcaatcgacatacagtttcagagctatgctggaaacagc

SEQ ID NO: 57359 - DNA, 70 bp, Artificial Sequence
  Synthetic
gccaagcatttaggtgacactataggtgccctgcggcagcctcacgtttcagagctatgctggaaacagc

SEQ ID NO: 57360 - DNA, 70 bp, Artificial Sequence
  Synthetic
gccaagcatttaggtgacactatagtgaatccaaaggaacagatggtttcagagctatgctggaaacagc

SEQ ID NO: 57361 - DNA, 70 bp, Artificial Sequence
  Synthetic
gccaagcatttaggtgacactataggccaagcagctacctgaagagtttcagagctatgctggaaacagc

SEQ ID NO: 57362 - DNA, 70 bp, Artificial Sequence
  Synthetic
gccaagcatttaggtgacactatagatccagtctttcgtactacagtttcagagctatgctggaaacagc

SEQ ID NO: 57363 - DNA, 70 bp, Artificial Sequence
  Synthetic
gccaagcatttaggtgacactatagcggtggtgggcaggccttaggtttcagagctatgctggaaacagc

SEQ ID NO: 57364 - DNA, 70 bp, Artificial Sequence
  Synthetic
gccaagcatttaggtgacactatagccggaagcggggccttgagtgtttcagagctatgctggaaacagc

SEQ ID NO: 57365 - DNA, 70 bp, Artificial Sequence
  Synthetic
gccaagcatttaggtgacactatagaatacgagtggctttcatgggtttcagagctatgctggaaacagc

SEQ ID NO: 57366 - DNA, 70 bp, Artificial Sequence
  Synthetic
gccaagcatttaggtgacactatagatgtgtattccttcattaccgtttcagagctatgctggaaacagc

SEQ ID NO: 57367 - DNA, 70 bp, Artificial Sequence
  Synthetic
gccaagcatttaggtgacactatagagcatggccagctggagaacgtttcagagctatgctggaaacagc

SEQ ID NO: 57368 - DNA, 70 bp, Artificial Sequence
  Synthetic
gccaagcatttaggtgacactatagggcctcagaaaccaaagacagtttcagagctatgctggaaacagc

SEQ ID NO: 57369 - DNA, 70 bp, Artificial Sequence
  Synthetic
gccaagcatttaggtgacactatagtactgtggtctcactagtcagtttcagagctatgctggaaacagc

SEQ ID NO: 57370 - DNA, 70 bp, Artificial Sequence
  Synthetic
gccaagcatttaggtgacactatagtcagtgacttctctccaagagtttcagagctatgctggaaacagc

SEQ ID NO: 57371 - DNA, 70 bp, Artificial Sequence
  Synthetic
gccaagcatttaggtgacactatagcttcagctgatgaactcttagtttcagagctatgctggaaacagc

SEQ ID NO: 57372 - DNA, 70 bp, Artificial Sequence
  Synthetic
gccaagcatttaggtgacactatagatcaaaagtttctccatccagtttcagagctatgctggaaacagc

SEQ ID NO: 57373 - DNA, 70 bp, Artificial Sequence
  Synthetic
gccaagcatttaggtgacactatagtgaggaggaggataatgacagtttcagagctatgctggaaacagc

SEQ ID NO: 57374 - DNA, 70 bp, Artificial Sequence
  Synthetic
gccaagcatttaggtgacactatagtaaggcacttagtttaagacgtttcagagctatgctggaaacagc

SEQ ID NO: 57375 - DNA, 70 bp, Artificial Sequence
  Synthetic
gccaagcatttaggtgacactatagagtacatgagctgtgcaaaggtttcagagctatgctggaaacagc

SEQ ID NO: 57376 - DNA, 70 bp, Artificial Sequence
  Synthetic
gccaagcatttaggtgacactatagcctcgaccattcgtttgtcagtttcagagctatgctggaaacagc

SEQ ID NO: 57377 - DNA, 70 bp, Artificial Sequence
  Synthetic
gccaagcatttaggtgacactataggatgctgtgcacactgtggagtttcagagctatgctggaaacagc

SEQ ID NO: 57378 - DNA, 70 bp, Artificial Sequence
  Synthetic
gccaagcatttaggtgacactatagattcagctctcagggtccaggtttcagagctatgctggaaacagc

SEQ ID NO: 57379 - DNA, 70 bp, Artificial Sequence
  Synthetic
gccaagcatttaggtgacactatagagaactggaccaggatgaaagtttcagagctatgctggaaacagc

SEQ ID NO: 57380 - DNA, 70 bp, Artificial Sequence
  Synthetic
gccaagcatttaggtgacactatagagtcagcagcagaaacgacagtttcagagctatgctggaaacagc

SEQ ID NO: 57381 - DNA, 70 bp, Artificial Sequence
  Synthetic
gccaagcatttaggtgacactataggaaatccccagctcccctctgtttcagagctatgctggaaacagc

SEQ ID NO: 57382 - DNA, 70 bp, Artificial Sequence
  Synthetic
gccaagcatttaggtgacactatagatacagtatcagaagaggcagtttcagagctatgctggaaacagc

SEQ ID NO: 57383 - DNA, 70 bp, Artificial Sequence
  Synthetic
gccaagcatttaggtgacactatagatgcgtacaggcttgtcagcgtttcagagctatgctggaaacagc

SEQ ID NO: 57384 - DNA, 70 bp, Artificial Sequence
  Synthetic
gccaagcatttaggtgacactatagcaacgcttgaatatggctgagtttcagagctatgctggaaacagc

SEQ ID NO: 57385 - DNA, 70 bp, Artificial Sequence
  Synthetic
gccaagcatttaggtgacactatagatgagatccagcaggagttcgtttcagagctatgctggaaacagc

SEQ ID NO: 57386 - DNA, 70 bp, Artificial Sequence
  Synthetic
gccaagcatttaggtgacactatagatggtggtcatggagtagaagtttcagagctatgctggaaacagc

SEQ ID NO: 57387 - DNA, 70 bp, Artificial Sequence
  Synthetic
gccaagcatttaggtgacactatagccaagcgctcactggtctaggtttcagagctatgctggaaacagc

SEQ ID NO: 57388 - DNA, 70 bp, Artificial Sequence
  Synthetic
gccaagcatttaggtgacactataggaccttggacagccagatccgtttcagagctatgctggaaacagc

SEQ ID NO: 57389 - DNA, 70 bp, Artificial Sequence
  Synthetic
gccaagcatttaggtgacactatagcccccctagggactcattccgtttcagagctatgctggaaacagc

SEQ ID NO: 57390 - DNA, 70 bp, Artificial Sequence
  Synthetic
gccaagcatttaggtgacactataggggcgtgtctccaccactacgtttcagagctatgctggaaacagc

SEQ ID NO: 57391 - DNA, 70 bp, Artificial Sequence
  Synthetic
gccaagcatttaggtgacactatagacaggcccgctgctcttagtgtttcagagctatgctggaaacagc

SEQ ID NO: 57392 - DNA, 70 bp, Artificial Sequence
  Synthetic
gccaagcatttaggtgacactatagaactgttttcatgacccgccgtttcagagctatgctggaaacagc

SEQ ID NO: 57393 - DNA, 70 bp, Artificial Sequence
  Synthetic
gccaagcatttaggtgacactataggcaggacttctcttctgagcgtttcagagctatgctggaaacagc

SEQ ID NO: 57394 - DNA, 70 bp, Artificial Sequence
  Synthetic
gccaagcatttaggtgacactatagagcaatctctacatcttggcgtttcagagctatgctggaaacagc

SEQ ID NO: 57395 - DNA, 70 bp, Artificial Sequence
  Synthetic
gccaagcatttaggtgacactataggatgaacaataaactggctggtttcagagctatgctggaaacagc

SEQ ID NO: 57396 - DNA, 70 bp, Artificial Sequence
  Synthetic
gccaagcatttaggtgacactatagtgtcaaggggtgagtgtcaagtttcagagctatgctggaaacagc

SEQ ID NO: 57397 - DNA, 70 bp, Artificial Sequence
  Synthetic
gccaagcatttaggtgacactataggcagtcacacgttgagaatcgtttcagagctatgctggaaacagc

SEQ ID NO: 57398 - DNA, 70 bp, Artificial Sequence
  Synthetic
gccaagcatttaggtgacactataggggcccctgcctcaggtagagtttcagagctatgctggaaacagc

SEQ ID NO: 57399 - DNA, 70 bp, Artificial Sequence
  Synthetic
gccaagcatttaggtgacactatagtccaaggcaaaccctcttaagtttcagagctatgctggaaacagc

SEQ ID NO: 57400 - DNA, 70 bp, Artificial Sequence
  Synthetic
gccaagcatttaggtgacactatagatgctgtatttgtcaacagagtttcagagctatgctggaaacagc

SEQ ID NO: 57401 - DNA, 70 bp, Artificial Sequence
  Synthetic
gccaagcatttaggtgacactatagttattgtctaaaggtgtctggtttcagagctatgctggaaacagc

SEQ ID NO: 57402 - DNA, 70 bp, Artificial Sequence
  Synthetic
gccaagcatttaggtgacactatagtttgcgaacacagttctgctgtttcagagctatgctggaaacagc

SEQ ID NO: 57403 - DNA, 70 bp, Artificial Sequence
  Synthetic
gccaagcatttaggtgacactatagtttaagatctgtatcctggcgtttcagagctatgctggaaacagc

SEQ ID NO: 57404 - DNA, 70 bp, Artificial Sequence
  Synthetic
gccaagcatttaggtgacactatagcaggacccctgggttgttgcgtttcagagctatgctggaaacagc

SEQ ID NO: 57405 - DNA, 70 bp, Artificial Sequence
  Synthetic
gccaagcatttaggtgacactatagtcagatatatgacaagcagtgtttcagagctatgctggaaacagc

SEQ ID NO: 57406 - DNA, 70 bp, Artificial Sequence
  Synthetic
gccaagcatttaggtgacactatagagcctggagattgagcagtggtttcagagctatgctggaaacagc

SEQ ID NO: 57407 - DNA, 70 bp, Artificial Sequence
  Synthetic
gccaagcatttaggtgacactataggagcccagagatcttcacaggtttcagagctatgctggaaacagc

SEQ ID NO: 57408 - DNA, 70 bp, Artificial Sequence
  Synthetic
gccaagcatttaggtgacactatagcggagtggcatgaagctgtagtttcagagctatgctggaaacagc

SEQ ID NO: 57409 - DNA, 70 bp, Artificial Sequence
  Synthetic
gccaagcatttaggtgacactatagaccccttgaccaagaagagagtttcagagctatgctggaaacagc

SEQ ID NO: 57410 - DNA, 70 bp, Artificial Sequence
  Synthetic
gccaagcatttaggtgacactatagtcacctcatggatattgaatgtttcagagctatgctggaaacagc

SEQ ID NO: 57411 - DNA, 70 bp, Artificial Sequence
  Synthetic
gccaagcatttaggtgacactatagttttccactcatctataagggtttcagagctatgctggaaacagc

SEQ ID NO: 57412 - DNA, 70 bp, Artificial Sequence
  Synthetic
gccaagcatttaggtgacactatagggagtagggcggctcacacagtttcagagctatgctggaaacagc

SEQ ID NO: 57413 - DNA, 70 bp, Artificial Sequence
  Synthetic
gccaagcatttaggtgacactatagtggtaagaatgggggccaccgtttcagagctatgctggaaacagc

SEQ ID NO: 57414 - DNA, 70 bp, Artificial Sequence
  Synthetic
gccaagcatttaggtgacactatagctgggggcaggggagcaggggtttcagagctatgctggaaacagc

SEQ ID NO: 57415 - DNA, 70 bp, Artificial Sequence
  Synthetic
gccaagcatttaggtgacactataggagatgtctgtctgggctaggtttcagagctatgctggaaacagc

SEQ ID NO: 57416 - DNA, 70 bp, Artificial Sequence
  Synthetic
gccaagcatttaggtgacactatagaggtccgacgacaggctcacgtttcagagctatgctggaaacagc

SEQ ID NO: 57417 - DNA, 70 bp, Artificial Sequence
  Synthetic
gccaagcatttaggtgacactatagtctccaaagaaaggtggtgagtttcagagctatgctggaaacagc

SEQ ID NO: 57418 - DNA, 70 bp, Artificial Sequence
  Synthetic
gccaagcatttaggtgacactatagatgctgctgtatgtttgatggtttcagagctatgctggaaacagc

SEQ ID NO: 57419 - DNA, 70 bp, Artificial Sequence
  Synthetic
gccaagcatttaggtgacactataggcacaggctgggggcctcaggtttcagagctatgctggaaacagc

SEQ ID NO: 57420 - DNA, 70 bp, Artificial Sequence
  Synthetic
gccaagcatttaggtgacactatagagtcatctacagcagcccaggtttcagagctatgctggaaacagc

SEQ ID NO: 57421 - DNA, 70 bp, Artificial Sequence
  Synthetic
gccaagcatttaggtgacactatagccaagaatggagttatacgggtttcagagctatgctggaaacagc

SEQ ID NO: 57422 - DNA, 70 bp, Artificial Sequence
  Synthetic
gccaagcatttaggtgacactatagcggggctgcacagctactccgtttcagagctatgctggaaacagc

SEQ ID NO: 57423 - DNA, 70 bp, Artificial Sequence
  Synthetic
gccaagcatttaggtgacactatagagcggtgggcaggctactccgtttcagagctatgctggaaacagc

SEQ ID NO: 57424 - DNA, 70 bp, Artificial Sequence
  Synthetic
gccaagcatttaggtgacactatagggcagggcagcagcttcactgtttcagagctatgctggaaacagc

SEQ ID NO: 57425 - DNA, 70 bp, Artificial Sequence
  Synthetic
gccaagcatttaggtgacactatagcccgaagtcatcctgggtatgtttcagagctatgctggaaacagc

SEQ ID NO: 57426 - DNA, 70 bp, Artificial Sequence
  Synthetic
gccaagcatttaggtgacactatagcctgaggcattaagaaagcagtttcagagctatgctggaaacagc

SEQ ID NO: 57427 - DNA, 70 bp, Artificial Sequence
  Synthetic
gccaagcatttaggtgacactatagccttgaaggctgtcgatgatgtttcagagctatgctggaaacagc

SEQ ID NO: 57428 - DNA, 70 bp, Artificial Sequence
  Synthetic
gccaagcatttaggtgacactatagtgggaagaaagaagcaagaagtttcagagctatgctggaaacagc

SEQ ID NO: 57429 - DNA, 70 bp, Artificial Sequence
  Synthetic
gccaagcatttaggtgacactatagaggccagtgtcactgctgccgtttcagagctatgctggaaacagc

SEQ ID NO: 57430 - DNA, 70 bp, Artificial Sequence
  Synthetic
gccaagcatttaggtgacactatagaaaggatcccagaaagtttcgtttcagagctatgctggaaacagc

SEQ ID NO: 57431 - DNA, 70 bp, Artificial Sequence
  Synthetic
gccaagcatttaggtgacactatagagaatcctctgctcacaaccgtttcagagctatgctggaaacagc

SEQ ID NO: 57432 - DNA, 70 bp, Artificial Sequence
  Synthetic
gccaagcatttaggtgacactatagaggagggcgcggtggctcaggtttcagagctatgctggaaacagc

SEQ ID NO: 57433 - DNA, 70 bp, Artificial Sequence
  Synthetic
gccaagcatttaggtgacactatagtccaaggccccatgagctacgtttcagagctatgctggaaacagc

SEQ ID NO: 57434 - DNA, 70 bp, Artificial Sequence
  Synthetic
gccaagcatttaggtgacactatagaagtctgaagctgtcattatgtttcagagctatgctggaaacagc

SEQ ID NO: 57435 - DNA, 70 bp, Artificial Sequence
  Synthetic
gccaagcatttaggtgacactatagtcgagccgtggaacggcgtagtttcagagctatgctggaaacagc

SEQ ID NO: 57436 - DNA, 70 bp, Artificial Sequence
  Synthetic
gccaagcatttaggtgacactatagtactcttcttgctcctcctggtttcagagctatgctggaaacagc

SEQ ID NO: 57437 - DNA, 70 bp, Artificial Sequence
  Synthetic
gccaagcatttaggtgacactatagggtcagtactcttcctgctggtttcagagctatgctggaaacagc

SEQ ID NO: 57438 - DNA, 70 bp, Artificial Sequence
  Synthetic
gccaagcatttaggtgacactatagaagaccaggacgagtactgagtttcagagctatgctggaaacagc

SEQ ID NO: 57439 - DNA, 70 bp, Artificial Sequence
  Synthetic
gccaagcatttaggtgacactataggccaagcagggtttgtgatcgtttcagagctatgctggaaacagc

SEQ ID NO: 57440 - DNA, 70 bp, Artificial Sequence
  Synthetic
gccaagcatttaggtgacactatagggacatacggttcccattacgtttcagagctatgctggaaacagc

SEQ ID NO: 57441 - DNA, 70 bp, Artificial Sequence
  Synthetic
gccaagcatttaggtgacactatagagatctcagtcaatccctccgtttcagagctatgctggaaacagc

SEQ ID NO: 57442 - DNA, 70 bp, Artificial Sequence
  Synthetic
gccaagcatttaggtgacactatagtggtgaccctgtgtatcggagtttcagagctatgctggaaacagc

SEQ ID NO: 57443 - DNA, 70 bp, Artificial Sequence
  Synthetic
gccaagcatttaggtgacactatagctgaagttgtatcagtctgagtttcagagctatgctggaaacagc

SEQ ID NO: 57444 - DNA, 70 bp, Artificial Sequence
  Synthetic
gccaagcatttaggtgacactatagcaaagccaggtcgtctagcagtttcagagctatgctggaaacagc

SEQ ID NO: 57445 - DNA, 70 bp, Artificial Sequence
  Synthetic
gccaagcatttaggtgacactatagggccagtcctgccattttgagtttcagagctatgctggaaacagc

SEQ ID NO: 57446 - DNA, 70 bp, Artificial Sequence
  Synthetic
gccaagcatttaggtgacactatagagaagataacagctcggggggtttcagagctatgctggaaacagc

SEQ ID NO: 57447 - DNA, 70 bp, Artificial Sequence
  Synthetic
gccaagcatttaggtgacactatagggagagcccagcattcatacgtttcagagctatgctggaaacagc

SEQ ID NO: 57448 - DNA, 70 bp, Artificial Sequence
  Synthetic
gccaagcatttaggtgacactatagttcggtcaagaggaactcaagtttcagagctatgctggaaacagc

SEQ ID NO: 57449 - DNA, 70 bp, Artificial Sequence
  Synthetic
gccaagcatttaggtgacactatagtgactctcatgaccagctctgtttcagagctatgctggaaacagc

SEQ ID NO: 57450 - DNA, 70 bp, Artificial Sequence
  Synthetic
gccaagcatttaggtgacactatagacagcagcaatatttacgacgtttcagagctatgctggaaacagc

SEQ ID NO: 57451 - DNA, 70 bp, Artificial Sequence
  Synthetic
gccaagcatttaggtgacactatagctttattcttgggatgactggtttcagagctatgctggaaacagc

SEQ ID NO: 57452 - DNA, 70 bp, Artificial Sequence
  Synthetic
gccaagcatttaggtgacactatagaagaagacggagaccataacgtttcagagctatgctggaaacagc

SEQ ID NO: 57453 - DNA, 70 bp, Artificial Sequence
  Synthetic
gccaagcatttaggtgacactatagtgcacagagcctgaagacacgtttcagagctatgctggaaacagc

SEQ ID NO: 57454 - DNA, 70 bp, Artificial Sequence
  Synthetic
gccaagcatttaggtgacactatagagggtcactacagtctgaacgtttcagagctatgctggaaacagc

SEQ ID NO: 57455 - DNA, 70 bp, Artificial Sequence
  Synthetic
gccaagcatttaggtgacactatagagaagcccccccagcggagggtttcagagctatgctggaaacagc

SEQ ID NO: 57456 - DNA, 70 bp, Artificial Sequence
  Synthetic
gccaagcatttaggtgacactataggctgagcagaatgagtagctgtttcagagctatgctggaaacagc

SEQ ID NO: 57457 - DNA, 70 bp, Artificial Sequence
  Synthetic
gccaagcatttaggtgacactataggtggagtgcagcgtctgaccgtttcagagctatgctggaaacagc

SEQ ID NO: 57458 - DNA, 70 bp, Artificial Sequence
  Synthetic
gccaagcatttaggtgacactatagtccaaatgggagttaaagctgtttcagagctatgctggaaacagc

SEQ ID NO: 57459 - DNA, 70 bp, Artificial Sequence
  Synthetic
gccaagcatttaggtgacactatagaaatcctaccagtctacaaagtttcagagctatgctggaaacagc

SEQ ID NO: 57460 - DNA, 70 bp, Artificial Sequence
  Synthetic
gccaagcatttaggtgacactatagttcgcttcaagcgaatatctgtttcagagctatgctggaaacagc

SEQ ID NO: 57461 - DNA, 70 bp, Artificial Sequence
  Synthetic
gccaagcatttaggtgacactatagcaacgagctgaagctttaacgtttcagagctatgctggaaacagc

SEQ ID NO: 57462 - DNA, 70 bp, Artificial Sequence
  Synthetic
gccaagcatttaggtgacactataggggttacagctttagctcatgtttcagagctatgctggaaacagc

SEQ ID NO: 57463 - DNA, 70 bp, Artificial Sequence
  Synthetic
gccaagcatttaggtgacactatagccgtggtggctcagagctcggtttcagagctatgctggaaacagc

SEQ ID NO: 57464 - DNA, 70 bp, Artificial Sequence
  Synthetic
gccaagcatttaggtgacactataggctggtcagcttcacactccgtttcagagctatgctggaaacagc

SEQ ID NO: 57465 - DNA, 70 bp, Artificial Sequence
  Synthetic
gccaagcatttaggtgacactatagaaaccccctgaagcccctaagtttcagagctatgctggaaacagc

SEQ ID NO: 57466 - DNA, 70 bp, Artificial Sequence
  Synthetic
gccaagcatttaggtgacactatagaagaactgagtttctaggtcgtttcagagctatgctggaaacagc

SEQ ID NO: 57467 - DNA, 70 bp, Artificial Sequence
  Synthetic
gccaagcatttaggtgacactatagggcaagcaggaggtggcgtggtttcagagctatgctggaaacagc

SEQ ID NO: 57468 - DNA, 70 bp, Artificial Sequence
  Synthetic
gccaagcatttaggtgacactatagacatcattcggaaagccgacgtttcagagctatgctggaaacagc

SEQ ID NO: 57469 - DNA, 70 bp, Artificial Sequence
  Synthetic
gccaagcatttaggtgacactataggcaccggaatatctgtggtcgtttcagagctatgctggaaacagc

SEQ ID NO: 57470 - DNA, 70 bp, Artificial Sequence
  Synthetic
gccaagcatttaggtgacactatagtaaagggctaccgaaaagttgtttcagagctatgctggaaacagc

SEQ ID NO: 57471 - DNA, 70 bp, Artificial Sequence
  Synthetic
gccaagcatttaggtgacactatagcaattgtctttctggcgccggtttcagagctatgctggaaacagc

SEQ ID NO: 57472 - DNA, 70 bp, Artificial Sequence
  Synthetic
gccaagcatttaggtgacactatagcagggagcacagggtcgatggtttcagagctatgctggaaacagc

SEQ ID NO: 57473 - DNA, 70 bp, Artificial Sequence
  Synthetic
gccaagcatttaggtgacactatagagtgtctgaaggatgggacggtttcagagctatgctggaaacagc

SEQ ID NO: 57474 - DNA, 70 bp, Artificial Sequence
  Synthetic
gccaagcatttaggtgacactatagccaaattcagttcctcactcgtttcagagctatgctggaaacagc

SEQ ID NO: 57475 - DNA, 70 bp, Artificial Sequence
  Synthetic
gccaagcatttaggtgacactatagttgtggagccccaggtggaagtttcagagctatgctggaaacagc

SEQ ID NO: 57476 - DNA, 70 bp, Artificial Sequence
  Synthetic
gccaagcatttaggtgacactatagactaattatgttctcgatccgtttcagagctatgctggaaacagc

SEQ ID NO: 57477 - DNA, 70 bp, Artificial Sequence
  Synthetic
gccaagcatttaggtgacactatagggagctccaggggaggctaggtttcagagctatgctggaaacagc

SEQ ID NO: 57478 - DNA, 70 bp, Artificial Sequence
  Synthetic
gccaagcatttaggtgacactataggacccccttggctatggtccgtttcagagctatgctggaaacagc

SEQ ID NO: 57479 - DNA, 70 bp, Artificial Sequence
  Synthetic
gccaagcatttaggtgacactatagaaagcatcgggatttggcatgtttcagagctatgctggaaacagc

SEQ ID NO: 57480 - DNA, 70 bp, Artificial Sequence
  Synthetic
gccaagcatttaggtgacactatagggcaggggatcagtctcttcgtttcagagctatgctggaaacagc

SEQ ID NO: 57481 - DNA, 70 bp, Artificial Sequence
  Synthetic
gccaagcatttaggtgacactatagatgtggtggcaattcatccagtttcagagctatgctggaaacagc

SEQ ID NO: 57482 - DNA, 70 bp, Artificial Sequence
  Synthetic
gccaagcatttaggtgacactatagcacaaaaaggccttgtaacggtttcagagctatgctggaaacagc

SEQ ID NO: 57483 - DNA, 70 bp, Artificial Sequence
  Synthetic
gccaagcatttaggtgacactataggctcagcacctgactgtatcgtttcagagctatgctggaaacagc

SEQ ID NO: 57484 - DNA, 70 bp, Artificial Sequence
  Synthetic
gccaagcatttaggtgacactataggctctaaaatacaagcttccgtttcagagctatgctggaaacagc

SEQ ID NO: 57485 - DNA, 70 bp, Artificial Sequence
  Synthetic
gccaagcatttaggtgacactatagagctttttgggcacttcccagtttcagagctatgctggaaacagc

SEQ ID NO: 57486 - DNA, 70 bp, Artificial Sequence
  Synthetic
gccaagcatttaggtgacactatagtgacaagagatggagacaaagtttcagagctatgctggaaacagc

SEQ ID NO: 57487 - DNA, 70 bp, Artificial Sequence
  Synthetic
gccaagcatttaggtgacactatagccgggtggggtcagggctccgtttcagagctatgctggaaacagc

SEQ ID NO: 57488 - DNA, 70 bp, Artificial Sequence
  Synthetic
gccaagcatttaggtgacactatagctggagaacacagttgtctagtttcagagctatgctggaaacagc

SEQ ID NO: 57489 - DNA, 70 bp, Artificial Sequence
  Synthetic
gccaagcatttaggtgacactatagtgtatctcaggcgattttccgtttcagagctatgctggaaacagc

SEQ ID NO: 57490 - DNA, 70 bp, Artificial Sequence
  Synthetic
gccaagcatttaggtgacactataggatacgagctgaccttgtccgtttcagagctatgctggaaacagc

SEQ ID NO: 57491 - DNA, 70 bp, Artificial Sequence
  Synthetic
gccaagcatttaggtgacactatagagctggccaaccagaagtgagtttcagagctatgctggaaacagc

SEQ ID NO: 57492 - DNA, 70 bp, Artificial Sequence
  Synthetic
gccaagcatttaggtgacactatagagaagaacgcagacagaagagtttcagagctatgctggaaacagc

SEQ ID NO: 57493 - DNA, 70 bp, Artificial Sequence
  Synthetic
gccaagcatttaggtgacactatagtggccccatcaaggcctcacgtttcagagctatgctggaaacagc

SEQ ID NO: 57494 - DNA, 70 bp, Artificial Sequence
  Synthetic
gccaagcatttaggtgacactatagttcactagtgcagacgccgcgtttcagagctatgctggaaacagc

SEQ ID NO: 57495 - DNA, 70 bp, Artificial Sequence
  Synthetic
gccaagcatttaggtgacactatagaatgctcttctggagcagcagtttcagagctatgctggaaacagc

SEQ ID NO: 57496 - DNA, 70 bp, Artificial Sequence
  Synthetic
gccaagcatttaggtgacactatagcacttggtagcttgaaatgagtttcagagctatgctggaaacagc

SEQ ID NO: 57497 - DNA, 70 bp, Artificial Sequence
  Synthetic
gccaagcatttaggtgacactatagcctgccccgagtggcttagcgtttcagagctatgctggaaacagc

SEQ ID NO: 57498 - DNA, 70 bp, Artificial Sequence
  Synthetic
gccaagcatttaggtgacactatagtttccaactgttttctgccagtttcagagctatgctggaaacagc

SEQ ID NO: 57499 - DNA, 70 bp, Artificial Sequence
  Synthetic
gccaagcatttaggtgacactatagcaaccaacttggagctcaccgtttcagagctatgctggaaacagc

SEQ ID NO: 57500 - DNA, 70 bp, Artificial Sequence
  Synthetic
gccaagcatttaggtgacactatagccacagcccacctgctgagggtttcagagctatgctggaaacagc

SEQ ID NO: 57501 - DNA, 70 bp, Artificial Sequence
  Synthetic
gccaagcatttaggtgacactataggagcggcaggggcctagcccgtttcagagctatgctggaaacagc

SEQ ID NO: 57502 - DNA, 70 bp, Artificial Sequence
  Synthetic
gccaagcatttaggtgacactatagtctcaagtttttctgtcctggtttcagagctatgctggaaacagc

SEQ ID NO: 57503 - DNA, 70 bp, Artificial Sequence
  Synthetic
gccaagcatttaggtgacactatagtcaatcctgacgatgtcacagtttcagagctatgctggaaacagc

SEQ ID NO: 57504 - DNA, 70 bp, Artificial Sequence
  Synthetic
gccaagcatttaggtgacactatagaccacccaaccccagtattcgtttcagagctatgctggaaacagc

SEQ ID NO: 57505 - DNA, 70 bp, Artificial Sequence
  Synthetic
gccaagcatttaggtgacactatagcacctccagcttcgatgatggtttcagagctatgctggaaacagc

SEQ ID NO: 57506 - DNA, 70 bp, Artificial Sequence
  Synthetic
gccaagcatttaggtgacactataggaaacacaaatcagggaaccgtttcagagctatgctggaaacagc

SEQ ID NO: 57507 - DNA, 70 bp, Artificial Sequence
  Synthetic
gccaagcatttaggtgacactatagggagctagaaagcagtagacgtttcagagctatgctggaaacagc

SEQ ID NO: 57508 - DNA, 70 bp, Artificial Sequence
  Synthetic
gccaagcatttaggtgacactataggggtgtcctgcagaagaagcgtttcagagctatgctggaaacagc

SEQ ID NO: 57509 - DNA, 70 bp, Artificial Sequence
  Synthetic
gccaagcatttaggtgacactatagatggatattgaaatggacaggtttcagagctatgctggaaacagc

SEQ ID NO: 57510 - DNA, 70 bp, Artificial Sequence
  Synthetic
gccaagcatttaggtgacactataggcaccagggaagcattatgggtttcagagctatgctggaaacagc

SEQ ID NO: 57511 - DNA, 70 bp, Artificial Sequence
  Synthetic
gccaagcatttaggtgacactatagccggagatggagcacgtctagtttcagagctatgctggaaacagc

SEQ ID NO: 57512 - DNA, 70 bp, Artificial Sequence
  Synthetic
gccaagcatttaggtgacactatagtttcttagcgtttttcaggagtttcagagctatgctggaaacagc

SEQ ID NO: 57513 - DNA, 70 bp, Artificial Sequence
  Synthetic
gccaagcatttaggtgacactatagcgggcagaaatgctgacagggtttcagagctatgctggaaacagc

SEQ ID NO: 57514 - DNA, 70 bp, Artificial Sequence
  Synthetic
gccaagcatttaggtgacactatagtgtcagcatttctgcctgccgtttcagagctatgctggaaacagc

SEQ ID NO: 57515 - DNA, 70 bp, Artificial Sequence
  Synthetic
gccaagcatttaggtgacactatagaggcagaaatgctgacaggtgtttcagagctatgctggaaacagc

SEQ ID NO: 57516 - DNA, 70 bp, Artificial Sequence
  Synthetic
gccaagcatttaggtgacactatagccaattgagcttcatgggatgtttcagagctatgctggaaacagc

SEQ ID NO: 57517 - DNA, 70 bp, Artificial Sequence
  Synthetic
gccaagcatttaggtgacactatagttcagcacatttggtctctggtttcagagctatgctggaaacagc

SEQ ID NO: 57518 - DNA, 70 bp, Artificial Sequence
  Synthetic
gccaagcatttaggtgacactatagttgtgtcaatgagtggaagcgtttcagagctatgctggaaacagc

SEQ ID NO: 57519 - DNA, 70 bp, Artificial Sequence
  Synthetic
gccaagcatttaggtgacactataggtggagtagtctctgttatcgtttcagagctatgctggaaacagc

SEQ ID NO: 57520 - DNA, 70 bp, Artificial Sequence
  Synthetic
gccaagcatttaggtgacactataggctccaggtatggctgctatgtttcagagctatgctggaaacagc

SEQ ID NO: 57521 - DNA, 70 bp, Artificial Sequence
  Synthetic
gccaagcatttaggtgacactatagaaaatattgaggcccacttggtttcagagctatgctggaaacagc

SEQ ID NO: 57522 - DNA, 70 bp, Artificial Sequence
  Synthetic
gccaagcatttaggtgacactatagtgagaggagtttttcatggagtttcagagctatgctggaaacagc

SEQ ID NO: 57523 - DNA, 70 bp, Artificial Sequence
  Synthetic
gccaagcatttaggtgacactatagctgtgagttccctatctgaagtttcagagctatgctggaaacagc

SEQ ID NO: 57524 - DNA, 70 bp, Artificial Sequence
  Synthetic
gccaagcatttaggtgacactatagctctcgaggctgattagtgcgtttcagagctatgctggaaacagc

SEQ ID NO: 57525 - DNA, 70 bp, Artificial Sequence
  Synthetic
gccaagcatttaggtgacactatagtcagtatagatactagggcggtttcagagctatgctggaaacagc

SEQ ID NO: 57526 - DNA, 70 bp, Artificial Sequence
  Synthetic
gccaagcatttaggtgacactatagacatctgggtaacatacttggtttcagagctatgctggaaacagc

SEQ ID NO: 57527 - DNA, 70 bp, Artificial Sequence
  Synthetic
gccaagcatttaggtgacactatagcttgtggctagtcagatgttgtttcagagctatgctggaaacagc

SEQ ID NO: 57528 - DNA, 70 bp, Artificial Sequence
  Synthetic
gccaagcatttaggtgacactatagagtttgtggcaattctattggtttcagagctatgctggaaacagc

SEQ ID NO: 57529 - DNA, 70 bp, Artificial Sequence
  Synthetic
gccaagcatttaggtgacactatagggctgtggctgttgctgcgagtttcagagctatgctggaaacagc

SEQ ID NO: 57530 - DNA, 70 bp, Artificial Sequence
  Synthetic
gccaagcatttaggtgacactatagccgttcgctgcaccaactacgtttcagagctatgctggaaacagc

SEQ ID NO: 57531 - DNA, 70 bp, Artificial Sequence
  Synthetic
gccaagcatttaggtgacactatagttaatagagttcagagtctggtttcagagctatgctggaaacagc

SEQ ID NO: 57532 - DNA, 70 bp, Artificial Sequence
  Synthetic
gccaagcatttaggtgacactatagtcatcactaaagcagtgatcgtttcagagctatgctggaaacagc

SEQ ID NO: 57533 - DNA, 70 bp, Artificial Sequence
  Synthetic
gccaagcatttaggtgacactatagaagcagaatacagtacaccagtttcagagctatgctggaaacagc

SEQ ID NO: 57534 - DNA, 70 bp, Artificial Sequence
  Synthetic
gccaagcatttaggtgacactatagtgggcgggctcactcaccgcgtttcagagctatgctggaaacagc

SEQ ID NO: 57535 - DNA, 70 bp, Artificial Sequence
  Synthetic
gccaagcatttaggtgacactatagtcgtgacagcttactcctccgtttcagagctatgctggaaacagc

SEQ ID NO: 57536 - DNA, 70 bp, Artificial Sequence
  Synthetic
gccaagcatttaggtgacactatagaggtgagctctgaggagtaggtttcagagctatgctggaaacagc

SEQ ID NO: 57537 - DNA, 70 bp, Artificial Sequence
  Synthetic
gccaagcatttaggtgacactataggggttttcagcgtctagccagtttcagagctatgctggaaacagc

SEQ ID NO: 57538 - DNA, 70 bp, Artificial Sequence
  Synthetic
gccaagcatttaggtgacactatagatcaaacaagagccatgagggtttcagagctatgctggaaacagc

SEQ ID NO: 57539 - DNA, 70 bp, Artificial Sequence
  Synthetic
gccaagcatttaggtgacactatagaaagaccccttcggtgtgacgtttcagagctatgctggaaacagc

SEQ ID NO: 57540 - DNA, 70 bp, Artificial Sequence
  Synthetic
gccaagcatttaggtgacactataggactctggatggttacagcagtttcagagctatgctggaaacagc

SEQ ID NO: 57541 - DNA, 70 bp, Artificial Sequence
  Synthetic
gccaagcatttaggtgacactatagccgcgtgcaccgcgctcaccgtttcagagctatgctggaaacagc

SEQ ID NO: 57542 - DNA, 70 bp, Artificial Sequence
  Synthetic
gccaagcatttaggtgacactatagtgcagcaggtactggtagaagtttcagagctatgctggaaacagc

SEQ ID NO: 57543 - DNA, 70 bp, Artificial Sequence
  Synthetic
gccaagcatttaggtgacactatagggctgcaacggcatgaacttgtttcagagctatgctggaaacagc

SEQ ID NO: 57544 - DNA, 70 bp, Artificial Sequence
  Synthetic
gccaagcatttaggtgacactatagatctgctagacaagtcacaagtttcagagctatgctggaaacagc

SEQ ID NO: 57545 - DNA, 70 bp, Artificial Sequence
  Synthetic
gccaagcatttaggtgacactatagactttgtgcttaatcccttcgtttcagagctatgctggaaacagc

SEQ ID NO: 57546 - DNA, 70 bp, Artificial Sequence
  Synthetic
gccaagcatttaggtgacactataggagagaaatacatcgatctggtttcagagctatgctggaaacagc

SEQ ID NO: 57547 - DNA, 70 bp, Artificial Sequence
  Synthetic
gccaagcatttaggtgacactataggcgtctgaaatgaaacttaggtttcagagctatgctggaaacagc

SEQ ID NO: 57548 - DNA, 70 bp, Artificial Sequence
  Synthetic
gccaagcatttaggtgacactatagtgagccccctgcagtcatctgtttcagagctatgctggaaacagc

SEQ ID NO: 57549 - DNA, 70 bp, Artificial Sequence
  Synthetic
gccaagcatttaggtgacactatagagcgaagtttcattggtgtggtttcagagctatgctggaaacagc

SEQ ID NO: 57550 - DNA, 70 bp, Artificial Sequence
  Synthetic
gccaagcatttaggtgacactatagagaatcagacaaaagggaatgtttcagagctatgctggaaacagc

SEQ ID NO: 57551 - DNA, 70 bp, Artificial Sequence
  Synthetic
gccaagcatttaggtgacactatagcggtatcttcaggatgtaacgtttcagagctatgctggaaacagc

SEQ ID NO: 57552 - DNA, 70 bp, Artificial Sequence
  Synthetic
gccaagcatttaggtgacactatagcaccaagagagccttggagggtttcagagctatgctggaaacagc

SEQ ID NO: 57553 - DNA, 70 bp, Artificial Sequence
  Synthetic
gccaagcatttaggtgacactatagtggtggagtccttgtggaacgtttcagagctatgctggaaacagc

SEQ ID NO: 57554 - DNA, 70 bp, Artificial Sequence
  Synthetic
gccaagcatttaggtgacactatagtcctctcatttattgaggtggtttcagagctatgctggaaacagc

SEQ ID NO: 57555 - DNA, 70 bp, Artificial Sequence
  Synthetic
gccaagcatttaggtgacactatagaggagagccatctccgacacgtttcagagctatgctggaaacagc

SEQ ID NO: 57556 - DNA, 70 bp, Artificial Sequence
  Synthetic
gccaagcatttaggtgacactatagctgacaaagccccccgaaaagtttcagagctatgctggaaacagc

SEQ ID NO: 57557 - DNA, 70 bp, Artificial Sequence
  Synthetic
gccaagcatttaggtgacactatagtccgacctgcaggggtagcggtttcagagctatgctggaaacagc

SEQ ID NO: 57558 - DNA, 70 bp, Artificial Sequence
  Synthetic
gccaagcatttaggtgacactatagcgcagggaggtcagctctccgtttcagagctatgctggaaacagc

SEQ ID NO: 57559 - DNA, 70 bp, Artificial Sequence
  Synthetic
gccaagcatttaggtgacactatagagttcatcttcactcattaggtttcagagctatgctggaaacagc

SEQ ID NO: 57560 - DNA, 70 bp, Artificial Sequence
  Synthetic
gccaagcatttaggtgacactatagtacatcttctgaaaactagggtttcagagctatgctggaaacagc

SEQ ID NO: 57561 - DNA, 70 bp, Artificial Sequence
  Synthetic
gccaagcatttaggtgacactataggaggagaggacagaaagcaagtttcagagctatgctggaaacagc

SEQ ID NO: 57562 - DNA, 70 bp, Artificial Sequence
  Synthetic
gccaagcatttaggtgacactatagccaaagaagagcgactgagagtttcagagctatgctggaaacagc

SEQ ID NO: 57563 - DNA, 70 bp, Artificial Sequence
  Synthetic
gccaagcatttaggtgacactatagggaccacatcacagctcaacgtttcagagctatgctggaaacagc

SEQ ID NO: 57564 - DNA, 70 bp, Artificial Sequence
  Synthetic
gccaagcatttaggtgacactatagtgctggagtaggagctggttgtttcagagctatgctggaaacagc

SEQ ID NO: 57565 - DNA, 70 bp, Artificial Sequence
  Synthetic
gccaagcatttaggtgacactatagtctgaagttcgggttatttagtttcagagctatgctggaaacagc

SEQ ID NO: 57566 - DNA, 70 bp, Artificial Sequence
  Synthetic
gccaagcatttaggtgacactatagatgatcctgcagcagttctggtttcagagctatgctggaaacagc

SEQ ID NO: 57567 - DNA, 70 bp, Artificial Sequence
  Synthetic
gccaagcatttaggtgacactatagatcatcttcctcatctgagggtttcagagctatgctggaaacagc

SEQ ID NO: 57568 - DNA, 70 bp, Artificial Sequence
  Synthetic
gccaagcatttaggtgacactatagctctgcgctgctagacatgggtttcagagctatgctggaaacagc

SEQ ID NO: 57569 - DNA, 70 bp, Artificial Sequence
  Synthetic
gccaagcatttaggtgacactatagaaggcttcagagcaagcgcagtttcagagctatgctggaaacagc

SEQ ID NO: 57570 - DNA, 70 bp, Artificial Sequence
  Synthetic
gccaagcatttaggtgacactataggaggcggcgcgactcacttggtttcagagctatgctggaaacagc

SEQ ID NO: 57571 - DNA, 70 bp, Artificial Sequence
  Synthetic
gccaagcatttaggtgacactatagcaatcttcgagcaagtagttgtttcagagctatgctggaaacagc

SEQ ID NO: 57572 - DNA, 70 bp, Artificial Sequence
  Synthetic
gccaagcatttaggtgacactatagagacaaaagtgatccgtgtcgtttcagagctatgctggaaacagc

SEQ ID NO: 57573 - DNA, 70 bp, Artificial Sequence
  Synthetic
gccaagcatttaggtgacactatagcagggttacctcttgaaaaagtttcagagctatgctggaaacagc

SEQ ID NO: 57574 - DNA, 70 bp, Artificial Sequence
  Synthetic
gccaagcatttaggtgacactatagggaattggatctactagtgcgtttcagagctatgctggaaacagc

SEQ ID NO: 57575 - DNA, 70 bp, Artificial Sequence
  Synthetic
gccaagcatttaggtgacactatagtgaagcatttgattgtgactgtttcagagctatgctggaaacagc

SEQ ID NO: 57576 - DNA, 70 bp, Artificial Sequence
  Synthetic
gccaagcatttaggtgacactatagcagcagcaaaaatgtgtgaagtttcagagctatgctggaaacagc

SEQ ID NO: 57577 - DNA, 70 bp, Artificial Sequence
  Synthetic
gccaagcatttaggtgacactatagacatccctcacattgaaatagtttcagagctatgctggaaacagc

SEQ ID NO: 57578 - DNA, 70 bp, Artificial Sequence
  Synthetic
gccaagcatttaggtgacactatagatcagaacaggctctgtatggtttcagagctatgctggaaacagc

SEQ ID NO: 57579 - DNA, 70 bp, Artificial Sequence
  Synthetic
gccaagcatttaggtgacactatagctagagaaaatagttgtcccgtttcagagctatgctggaaacagc

SEQ ID NO: 57580 - DNA, 70 bp, Artificial Sequence
  Synthetic
gccaagcatttaggtgacactatagctcggaggagcattcgctgcgtttcagagctatgctggaaacagc

SEQ ID NO: 57581 - DNA, 70 bp, Artificial Sequence
  Synthetic
gccaagcatttaggtgacactatagcctgcatctgctgtcggagggtttcagagctatgctggaaacagc

SEQ ID NO: 57582 - DNA, 70 bp, Artificial Sequence
  Synthetic
gccaagcatttaggtgacactatagcagcagaataaagatactgggtttcagagctatgctggaaacagc

SEQ ID NO: 57583 - DNA, 70 bp, Artificial Sequence
  Synthetic
gccaagcatttaggtgacactatagaacttacccggaggatacaggtttcagagctatgctggaaacagc

SEQ ID NO: 57584 - DNA, 70 bp, Artificial Sequence
  Synthetic
gccaagcatttaggtgacactataggtcactgtcattgtgacaatgtttcagagctatgctggaaacagc

SEQ ID NO: 57585 - DNA, 70 bp, Artificial Sequence
  Synthetic
gccaagcatttaggtgacactatagtgacaataggtagttttcaggtttcagagctatgctggaaacagc

SEQ ID NO: 57586 - DNA, 70 bp, Artificial Sequence
  Synthetic
gccaagcatttaggtgacactatagccgggcgctctaggacttctgtttcagagctatgctggaaacagc

SEQ ID NO: 57587 - DNA, 70 bp, Artificial Sequence
  Synthetic
gccaagcatttaggtgacactataggaatcaccagctgttcctaggtttcagagctatgctggaaacagc

SEQ ID NO: 57588 - DNA, 70 bp, Artificial Sequence
  Synthetic
gccaagcatttaggtgacactatagcctgccaccactcctcactggtttcagagctatgctggaaacagc

SEQ ID NO: 57589 - DNA, 70 bp, Artificial Sequence
  Synthetic
gccaagcatttaggtgacactatagtatgggctatgagaaggatcgtttcagagctatgctggaaacagc

SEQ ID NO: 57590 - DNA, 70 bp, Artificial Sequence
  Synthetic
gccaagcatttaggtgacactatagaagaagcgcagcgctctctagtttcagagctatgctggaaacagc

SEQ ID NO: 57591 - DNA, 70 bp, Artificial Sequence
  Synthetic
gccaagcatttaggtgacactatagacccttttctctggtgacatgtttcagagctatgctggaaacagc

SEQ ID NO: 57592 - DNA, 70 bp, Artificial Sequence
  Synthetic
gccaagcatttaggtgacactatagaaacagcatgctctatgtgtgtttcagagctatgctggaaacagc

SEQ ID NO: 57593 - DNA, 70 bp, Artificial Sequence
  Synthetic
gccaagcatttaggtgacactatagcatctgcctctccgacaaatgtttcagagctatgctggaaacagc

SEQ ID NO: 57594 - DNA, 70 bp, Artificial Sequence
  Synthetic
gccaagcatttaggtgacactataggagaatgacgcgcctgtttcgtttcagagctatgctggaaacagc

SEQ ID NO: 57595 - DNA, 70 bp, Artificial Sequence
  Synthetic
gccaagcatttaggtgacactatagagacactttattagatccacgtttcagagctatgctggaaacagc

SEQ ID NO: 57596 - DNA, 70 bp, Artificial Sequence
  Synthetic
gccaagcatttaggtgacactatagagggtagtggagttctcagggtttcagagctatgctggaaacagc

SEQ ID NO: 57597 - DNA, 70 bp, Artificial Sequence
  Synthetic
gccaagcatttaggtgacactataggcccccgacagaggctcagggtttcagagctatgctggaaacagc

SEQ ID NO: 57598 - DNA, 70 bp, Artificial Sequence
  Synthetic
gccaagcatttaggtgacactatagcacgcttgttcagagagctggtttcagagctatgctggaaacagc

SEQ ID NO: 57599 - DNA, 70 bp, Artificial Sequence
  Synthetic
gccaagcatttaggtgacactataggaaatctgtatggaatgctggtttcagagctatgctggaaacagc

SEQ ID NO: 57600 - DNA, 70 bp, Artificial Sequence
  Synthetic
gccaagcatttaggtgacactatagatcatctctgcaacgccaaggtttcagagctatgctggaaacagc

SEQ ID NO: 57601 - DNA, 70 bp, Artificial Sequence
  Synthetic
gccaagcatttaggtgacactatagccaggataaggtcaccttcggtttcagagctatgctggaaacagc

SEQ ID NO: 57602 - DNA, 70 bp, Artificial Sequence
  Synthetic
gccaagcatttaggtgacactatagatcattgtctagtcaggcaggtttcagagctatgctggaaacagc

SEQ ID NO: 57603 - DNA, 70 bp, Artificial Sequence
  Synthetic
gccaagcatttaggtgacactatagtttgatctgttaggattccagtttcagagctatgctggaaacagc

SEQ ID NO: 57604 - DNA, 70 bp, Artificial Sequence
  Synthetic
gccaagcatttaggtgacactatagccgtcacagcggctcacttcgtttcagagctatgctggaaacagc

SEQ ID NO: 57605 - DNA, 70 bp, Artificial Sequence
  Synthetic
gccaagcatttaggtgacactatagagccaagaaagggaagggaagtttcagagctatgctggaaacagc

SEQ ID NO: 57606 - DNA, 70 bp, Artificial Sequence
  Synthetic
gccaagcatttaggtgacactatagaaaaggaaggagaatttctggtttcagagctatgctggaaacagc

SEQ ID NO: 57607 - DNA, 70 bp, Artificial Sequence
  Synthetic
gccaagcatttaggtgacactatagggaactggaacattctaccagtttcagagctatgctggaaacagc

SEQ ID NO: 57608 - DNA, 70 bp, Artificial Sequence
  Synthetic
gccaagcatttaggtgacactatagttcacaaagcttctcttatggtttcagagctatgctggaaacagc

SEQ ID NO: 57609 - DNA, 70 bp, Artificial Sequence
  Synthetic
gccaagcatttaggtgacactatagcttatagacaggtcaactaggtttcagagctatgctggaaacagc

SEQ ID NO: 57610 - DNA, 70 bp, Artificial Sequence
  Synthetic
gccaagcatttaggtgacactatagactttagccactgctactacgtttcagagctatgctggaaacagc

SEQ ID NO: 57611 - DNA, 70 bp, Artificial Sequence
  Synthetic
gccaagcatttaggtgacactatagagagattcagctggttattagtttcagagctatgctggaaacagc

SEQ ID NO: 57612 - DNA, 70 bp, Artificial Sequence
  Synthetic
gccaagcatttaggtgacactatagatgtatgcatttatgctctggtttcagagctatgctggaaacagc

SEQ ID NO: 57613 - DNA, 70 bp, Artificial Sequence
  Synthetic
gccaagcatttaggtgacactatagtcttctttctgttctatggggtttcagagctatgctggaaacagc

SEQ ID NO: 57614 - DNA, 70 bp, Artificial Sequence
  Synthetic
gccaagcatttaggtgacactatagaaactgggtactgagtgatggtttcagagctatgctggaaacagc

SEQ ID NO: 57615 - DNA, 70 bp, Artificial Sequence
  Synthetic
gccaagcatttaggtgacactatagctttcagtttaggcctcaaagtttcagagctatgctggaaacagc

SEQ ID NO: 57616 - DNA, 70 bp, Artificial Sequence
  Synthetic
gccaagcatttaggtgacactataggcctttgaggtccagccttggtttcagagctatgctggaaacagc

SEQ ID NO: 57617 - DNA, 70 bp, Artificial Sequence
  Synthetic
gccaagcatttaggtgacactatagtcccagcctccacaactgtggtttcagagctatgctggaaacagc

SEQ ID NO: 57618 - DNA, 70 bp, Artificial Sequence
  Synthetic
gccaagcatttaggtgacactatagacagaccaaagttgaccagtgtttcagagctatgctggaaacagc

SEQ ID NO: 57619 - DNA, 70 bp, Artificial Sequence
  Synthetic
gccaagcatttaggtgacactatagtaaacattgtttccttgaccgtttcagagctatgctggaaacagc

SEQ ID NO: 57620 - DNA, 70 bp, Artificial Sequence
  Synthetic
gccaagcatttaggtgacactatagtgcttctattctgttatcacgtttcagagctatgctggaaacagc

SEQ ID NO: 57621 - DNA, 70 bp, Artificial Sequence
  Synthetic
gccaagcatttaggtgacactatagatgaatgttcagacggtctggtttcagagctatgctggaaacagc

SEQ ID NO: 57622 - DNA, 70 bp, Artificial Sequence
  Synthetic
gccaagcatttaggtgacactatagctctcactgtggtcacttccgtttcagagctatgctggaaacagc

SEQ ID NO: 57623 - DNA, 70 bp, Artificial Sequence
  Synthetic
gccaagcatttaggtgacactatagaagggtatcacagatgaagcgtttcagagctatgctggaaacagc

SEQ ID NO: 57624 - DNA, 70 bp, Artificial Sequence
  Synthetic
gccaagcatttaggtgacactatagtcataatcaaacatgccagagtttcagagctatgctggaaacagc

SEQ ID NO: 57625 - DNA, 70 bp, Artificial Sequence
  Synthetic
gccaagcatttaggtgacactatagttcgctttttatggctgctggtttcagagctatgctggaaacagc

SEQ ID NO: 57626 - DNA, 70 bp, Artificial Sequence
  Synthetic
gccaagcatttaggtgacactatagaaccttgataacgtcatacggtttcagagctatgctggaaacagc

SEQ ID NO: 57627 - DNA, 70 bp, Artificial Sequence
  Synthetic
gccaagcatttaggtgacactataggtaaagtcagctaactctctgtttcagagctatgctggaaacagc

SEQ ID NO: 57628 - DNA, 70 bp, Artificial Sequence
  Synthetic
gccaagcatttaggtgacactataggctcttttgggatgatcacagtttcagagctatgctggaaacagc

SEQ ID NO: 57629 - DNA, 70 bp, Artificial Sequence
  Synthetic
gccaagcatttaggtgacactatagtgtggccctgattgggaattgtttcagagctatgctggaaacagc

SEQ ID NO: 57630 - DNA, 70 bp, Artificial Sequence
  Synthetic
gccaagcatttaggtgacactatagggagggtgagctggttaagagtttcagagctatgctggaaacagc

SEQ ID NO: 57631 - DNA, 70 bp, Artificial Sequence
  Synthetic
gccaagcatttaggtgacactatagggcctaacaaattcaaactcgtttcagagctatgctggaaacagc

SEQ ID NO: 57632 - DNA, 70 bp, Artificial Sequence
  Synthetic
gccaagcatttaggtgacactatagtgagcagatgctggagaactgtttcagagctatgctggaaacagc

SEQ ID NO: 57633 - DNA, 70 bp, Artificial Sequence
  Synthetic
gccaagcatttaggtgacactatagcagcccagtaccaacatattgtttcagagctatgctggaaacagc

SEQ ID NO: 57634 - DNA, 70 bp, Artificial Sequence
  Synthetic
gccaagcatttaggtgacactatagttgcagattcagaagtgtgagtttcagagctatgctggaaacagc

SEQ ID NO: 57635 - DNA, 70 bp, Artificial Sequence
  Synthetic
gccaagcatttaggtgacactatagatgtctcccaattcattttggtttcagagctatgctggaaacagc

SEQ ID NO: 57636 - DNA, 70 bp, Artificial Sequence
  Synthetic
gccaagcatttaggtgacactatagactgagtgagcaccacaaaggtttcagagctatgctggaaacagc

SEQ ID NO: 57637 - DNA, 70 bp, Artificial Sequence
  Synthetic
gccaagcatttaggtgacactatagagtgtctatggacgcccaccgtttcagagctatgctggaaacagc

SEQ ID NO: 57638 - DNA, 70 bp, Artificial Sequence
  Synthetic
gccaagcatttaggtgacactatagctgcattcattcaacagatggtttcagagctatgctggaaacagc

SEQ ID NO: 57639 - DNA, 70 bp, Artificial Sequence
  Synthetic
gccaagcatttaggtgacactatagtccctgcagtcttggctagggtttcagagctatgctggaaacagc

SEQ ID NO: 57640 - DNA, 70 bp, Artificial Sequence
  Synthetic
gccaagcatttaggtgacactatagatccagaggaccgtccgtgagtttcagagctatgctggaaacagc

SEQ ID NO: 57641 - DNA, 70 bp, Artificial Sequence
  Synthetic
gccaagcatttaggtgacactatagggccattcaaagaagttcaggtttcagagctatgctggaaacagc

SEQ ID NO: 57642 - DNA, 70 bp, Artificial Sequence
  Synthetic
gccaagcatttaggtgacactatagtcttagtcacatgagcctctgtttcagagctatgctggaaacagc

SEQ ID NO: 57643 - DNA, 70 bp, Artificial Sequence
  Synthetic
gccaagcatttaggtgacactatagcagcagcagcctacgctaatgtttcagagctatgctggaaacagc

SEQ ID NO: 57644 - DNA, 70 bp, Artificial Sequence
  Synthetic
gccaagcatttaggtgacactatagagctccatacggaacttaacgtttcagagctatgctggaaacagc

SEQ ID NO: 57645 - DNA, 70 bp, Artificial Sequence
  Synthetic
gccaagcatttaggtgacactatagagcagcaggtgccggtggctgtttcagagctatgctggaaacagc

SEQ ID NO: 57646 - DNA, 70 bp, Artificial Sequence
  Synthetic
gccaagcatttaggtgacactataggcagtcactagctaccacacgtttcagagctatgctggaaacagc

SEQ ID NO: 57647 - DNA, 70 bp, Artificial Sequence
  Synthetic
gccaagcatttaggtgacactatagatccactgatgctatgagtcgtttcagagctatgctggaaacagc

SEQ ID NO: 57648 - DNA, 70 bp, Artificial Sequence
  Synthetic
gccaagcatttaggtgacactatagaggctgagtgggtcacgaatgtttcagagctatgctggaaacagc

SEQ ID NO: 57649 - DNA, 70 bp, Artificial Sequence
  Synthetic
gccaagcatttaggtgacactatagggaggctcaggcgtgctcaggtttcagagctatgctggaaacagc

SEQ ID NO: 57650 - DNA, 70 bp, Artificial Sequence
  Synthetic
gccaagcatttaggtgacactatagctccacaagccatgaacagtgtttcagagctatgctggaaacagc

SEQ ID NO: 57651 - DNA, 70 bp, Artificial Sequence
  Synthetic
gccaagcatttaggtgacactataggtctggcttcactgagttacgtttcagagctatgctggaaacagc

SEQ ID NO: 57652 - DNA, 70 bp, Artificial Sequence
  Synthetic
gccaagcatttaggtgacactatagtccagcacctcagtctaatcgtttcagagctatgctggaaacagc

SEQ ID NO: 57653 - DNA, 70 bp, Artificial Sequence
  Synthetic
gccaagcatttaggtgacactatagagccattgctgcactctgaggtttcagagctatgctggaaacagc

SEQ ID NO: 57654 - DNA, 70 bp, Artificial Sequence
  Synthetic
gccaagcatttaggtgacactatagggattcagatgagatccatggtttcagagctatgctggaaacagc

SEQ ID NO: 57655 - DNA, 70 bp, Artificial Sequence
  Synthetic
gccaagcatttaggtgacactatagttatgtctgcttggactgacgtttcagagctatgctggaaacagc

SEQ ID NO: 57656 - DNA, 70 bp, Artificial Sequence
  Synthetic
gccaagcatttaggtgacactatagaatgtcttcagactttccaagtttcagagctatgctggaaacagc

SEQ ID NO: 57657 - DNA, 70 bp, Artificial Sequence
  Synthetic
gccaagcatttaggtgacactataggccagcgtgggggctactgcgtttcagagctatgctggaaacagc

SEQ ID NO: 57658 - DNA, 70 bp, Artificial Sequence
  Synthetic
gccaagcatttaggtgacactatagcctctgccctttgctcacgtgtttcagagctatgctggaaacagc

SEQ ID NO: 57659 - DNA, 70 bp, Artificial Sequence
  Synthetic
gccaagcatttaggtgacactatagcctgggggcactctgtgaaggtttcagagctatgctggaaacagc

SEQ ID NO: 57660 - DNA, 70 bp, Artificial Sequence
  Synthetic
gccaagcatttaggtgacactataggttggtgggtggtgtgcaaagtttcagagctatgctggaaacagc

SEQ ID NO: 57661 - DNA, 70 bp, Artificial Sequence
  Synthetic
gccaagcatttaggtgacactatagtaaatgccatgttggcaatggtttcagagctatgctggaaacagc

SEQ ID NO: 57662 - DNA, 70 bp, Artificial Sequence
  Synthetic
gccaagcatttaggtgacactatagttgctgttgctgctctgccagtttcagagctatgctggaaacagc

SEQ ID NO: 57663 - DNA, 70 bp, Artificial Sequence
  Synthetic
gccaagcatttaggtgacactatagagactcactactactgcttggtttcagagctatgctggaaacagc

SEQ ID NO: 57664 - DNA, 70 bp, Artificial Sequence
  Synthetic
gccaagcatttaggtgacactatagctaaaggcccccctgaaaaagtttcagagctatgctggaaacagc

SEQ ID NO: 57665 - DNA, 70 bp, Artificial Sequence
  Synthetic
gccaagcatttaggtgacactatagaccagaaactgtaaaacctggtttcagagctatgctggaaacagc

SEQ ID NO: 57666 - DNA, 70 bp, Artificial Sequence
  Synthetic
gccaagcatttaggtgacactatagctcatcaattaggacacacagtttcagagctatgctggaaacagc

SEQ ID NO: 57667 - DNA, 70 bp, Artificial Sequence
  Synthetic
gccaagcatttaggtgacactatagaaaatgcccacctgcagctcgtttcagagctatgctggaaacagc

SEQ ID NO: 57668 - DNA, 70 bp, Artificial Sequence
  Synthetic
gccaagcatttaggtgacactatagttgccagccacactcaccgcgtttcagagctatgctggaaacagc

SEQ ID NO: 57669 - DNA, 70 bp, Artificial Sequence
  Synthetic
gccaagcatttaggtgacactataggtcagcctcactctactcctgtttcagagctatgctggaaacagc

SEQ ID NO: 57670 - DNA, 70 bp, Artificial Sequence
  Synthetic
gccaagcatttaggtgacactatagattaccatttccaagtgttcgtttcagagctatgctggaaacagc

SEQ ID NO: 57671 - DNA, 70 bp, Artificial Sequence
  Synthetic
gccaagcatttaggtgacactatagatggacgcgtgggtgacctagtttcagagctatgctggaaacagc

SEQ ID NO: 57672 - DNA, 70 bp, Artificial Sequence
  Synthetic
gccaagcatttaggtgacactataggccaccgggtgatctcctacgtttcagagctatgctggaaacagc

SEQ ID NO: 57673 - DNA, 70 bp, Artificial Sequence
  Synthetic
gccaagcatttaggtgacactatagcatgcgactttctgaaggatgtttcagagctatgctggaaacagc

SEQ ID NO: 57674 - DNA, 70 bp, Artificial Sequence
  Synthetic
gccaagcatttaggtgacactatagagaggatgcggcttgataccgtttcagagctatgctggaaacagc

SEQ ID NO: 57675 - DNA, 70 bp, Artificial Sequence
  Synthetic
gccaagcatttaggtgacactataggcagtgttgggcattcagtcgtttcagagctatgctggaaacagc

SEQ ID NO: 57676 - DNA, 70 bp, Artificial Sequence
  Synthetic
gccaagcatttaggtgacactataggcctgagcgccaatcagctcgtttcagagctatgctggaaacagc

SEQ ID NO: 57677 - DNA, 70 bp, Artificial Sequence
  Synthetic
gccaagcatttaggtgacactatagcctaagcaagaggacagtgggtttcagagctatgctggaaacagc

SEQ ID NO: 57678 - DNA, 70 bp, Artificial Sequence
  Synthetic
gccaagcatttaggtgacactatagcgctgcctccccggatggtcgtttcagagctatgctggaaacagc

SEQ ID NO: 57679 - DNA, 70 bp, Artificial Sequence
  Synthetic
gccaagcatttaggtgacactatagcaggacaagcaatcttaagagtttcagagctatgctggaaacagc

SEQ ID NO: 57680 - DNA, 70 bp, Artificial Sequence
  Synthetic
gccaagcatttaggtgacactatagtgcctctactagtgcctcgcgtttcagagctatgctggaaacagc

SEQ ID NO: 57681 - DNA, 70 bp, Artificial Sequence
  Synthetic
gccaagcatttaggtgacactataggagaaccctgggcatgtcaggtttcagagctatgctggaaacagc

SEQ ID NO: 57682 - DNA, 70 bp, Artificial Sequence
  Synthetic
gccaagcatttaggtgacactatagagttatgtatgggcgtcgtcgtttcagagctatgctggaaacagc

SEQ ID NO: 57683 - DNA, 70 bp, Artificial Sequence
  Synthetic
gccaagcatttaggtgacactatagctgaggatcagtttctgatggtttcagagctatgctggaaacagc

SEQ ID NO: 57684 - DNA, 70 bp, Artificial Sequence
  Synthetic
gccaagcatttaggtgacactatagaaggaaatgcatcagaaagtgtttcagagctatgctggaaacagc

SEQ ID NO: 57685 - DNA, 70 bp, Artificial Sequence
  Synthetic
gccaagcatttaggtgacactatagtgtgaagaaacttcagagaagtttcagagctatgctggaaacagc

SEQ ID NO: 57686 - DNA, 70 bp, Artificial Sequence
  Synthetic
gccaagcatttaggtgacactatagtttttcacttgtctagttccgtttcagagctatgctggaaacagc

SEQ ID NO: 57687 - DNA, 70 bp, Artificial Sequence
  Synthetic
gccaagcatttaggtgacactataggaggcaagcagaaacttgtcgtttcagagctatgctggaaacagc

SEQ ID NO: 57688 - DNA, 70 bp, Artificial Sequence
  Synthetic
gccaagcatttaggtgacactataggtttgtttgtttcacctctcgtttcagagctatgctggaaacagc

SEQ ID NO: 57689 - DNA, 70 bp, Artificial Sequence
  Synthetic
gccaagcatttaggtgacactatagatatgggcatggaggggcaggtttcagagctatgctggaaacagc

SEQ ID NO: 57690 - DNA, 70 bp, Artificial Sequence
  Synthetic
gccaagcatttaggtgacactatagatatgggcatggatgggcaagtttcagagctatgctggaaacagc

SEQ ID NO: 57691 - DNA, 70 bp, Artificial Sequence
  Synthetic
gccaagcatttaggtgacactatagcaatgttggcggacaggttagtttcagagctatgctggaaacagc

SEQ ID NO: 57692 - DNA, 70 bp, Artificial Sequence
  Synthetic
gccaagcatttaggtgacactataggtttgaacttggaaggagaagtttcagagctatgctggaaacagc

SEQ ID NO: 57693 - DNA, 70 bp, Artificial Sequence
  Synthetic
gccaagcatttaggtgacactatagagacatcctatctagctgcagtttcagagctatgctggaaacagc

SEQ ID NO: 57694 - DNA, 70 bp, Artificial Sequence
  Synthetic
gccaagcatttaggtgacactataggcaaagagtagggatatgttgtttcagagctatgctggaaacagc

SEQ ID NO: 57695 - DNA, 70 bp, Artificial Sequence
  Synthetic
gccaagcatttaggtgacactatagggcggggcggccgggctcaggtttcagagctatgctggaaacagc

SEQ ID NO: 57696 - DNA, 70 bp, Artificial Sequence
  Synthetic
gccaagcatttaggtgacactatagctgaggattcagagcttcaggtttcagagctatgctggaaacagc

SEQ ID NO: 57697 - DNA, 70 bp, Artificial Sequence
  Synthetic
gccaagcatttaggtgacactatagcgaagtccccagtagttcaggtttcagagctatgctggaaacagc

SEQ ID NO: 57698 - DNA, 70 bp, Artificial Sequence
  Synthetic
gccaagcatttaggtgacactatagccccaatgggcaggaccctggtttcagagctatgctggaaacagc

SEQ ID NO: 57699 - DNA, 70 bp, Artificial Sequence
  Synthetic
gccaagcatttaggtgacactataggcagaatctcactctgaactgtttcagagctatgctggaaacagc

SEQ ID NO: 57700 - DNA, 70 bp, Artificial Sequence
  Synthetic
gccaagcatttaggtgacactatagagtgcgcatgctctgagctggtttcagagctatgctggaaacagc

SEQ ID NO: 57701 - DNA, 70 bp, Artificial Sequence
  Synthetic
gccaagcatttaggtgacactatagcagcaggcaggtcacttcctgtttcagagctatgctggaaacagc

SEQ ID NO: 57702 - DNA, 70 bp, Artificial Sequence
  Synthetic
gccaagcatttaggtgacactatagccaggaagaaatatcgtgaagtttcagagctatgctggaaacagc

SEQ ID NO: 57703 - DNA, 70 bp, Artificial Sequence
  Synthetic
gccaagcatttaggtgacactatagctgtttagggggccacttaggtttcagagctatgctggaaacagc

SEQ ID NO: 57704 - DNA, 70 bp, Artificial Sequence
  Synthetic
gccaagcatttaggtgacactatagggcagttcaagtgagagcgagtttcagagctatgctggaaacagc

SEQ ID NO: 57705 - DNA, 70 bp, Artificial Sequence
  Synthetic
gccaagcatttaggtgacactatagggctcagaagtcctgatgtggtttcagagctatgctggaaacagc

SEQ ID NO: 57706 - DNA, 70 bp, Artificial Sequence
  Synthetic
gccaagcatttaggtgacactatagaaaagagaagacctgtgatggtttcagagctatgctggaaacagc

SEQ ID NO: 57707 - DNA, 70 bp, Artificial Sequence
  Synthetic
gccaagcatttaggtgacactatagcctgaggagcccaagtgacagtttcagagctatgctggaaacagc

SEQ ID NO: 57708 - DNA, 70 bp, Artificial Sequence
  Synthetic
gccaagcatttaggtgacactatagcctgggcatcttctactaaagtttcagagctatgctggaaacagc

SEQ ID NO: 57709 - DNA, 70 bp, Artificial Sequence
  Synthetic
gccaagcatttaggtgacactatagttcatcaactccttctgagcgtttcagagctatgctggaaacagc

SEQ ID NO: 57710 - DNA, 70 bp, Artificial Sequence
  Synthetic
gccaagcatttaggtgacactataggcactatgatgtctcccagagtttcagagctatgctggaaacagc

SEQ ID NO: 57711 - DNA, 70 bp, Artificial Sequence
  Synthetic
gccaagcatttaggtgacactatagttacatcatgagaggaatgcgtttcagagctatgctggaaacagc

SEQ ID NO: 57712 - DNA, 70 bp, Artificial Sequence
  Synthetic
gccaagcatttaggtgacactatagcccggcgacttgacagtgcagtttcagagctatgctggaaacagc

SEQ ID NO: 57713 - DNA, 70 bp, Artificial Sequence
  Synthetic
gccaagcatttaggtgacactatagaaactaccccatgaggcctggtttcagagctatgctggaaacagc

SEQ ID NO: 57714 - DNA, 70 bp, Artificial Sequence
  Synthetic
gccaagcatttaggtgacactatagtgtaaagaagttgtcagcaggtttcagagctatgctggaaacagc

SEQ ID NO: 57715 - DNA, 70 bp, Artificial Sequence
  Synthetic
gccaagcatttaggtgacactatagcgaggtggcgctgcactgaggtttcagagctatgctggaaacagc

SEQ ID NO: 57716 - DNA, 70 bp, Artificial Sequence
  Synthetic
gccaagcatttaggtgacactataggaacccttgtgaggttggcagtttcagagctatgctggaaacagc

SEQ ID NO: 57717 - DNA, 70 bp, Artificial Sequence
  Synthetic
gccaagcatttaggtgacactatagagagtaagcagtcagtgaccgtttcagagctatgctggaaacagc

SEQ ID NO: 57718 - DNA, 70 bp, Artificial Sequence
  Synthetic
gccaagcatttaggtgacactatagagaggcacacgctcaaacaggtttcagagctatgctggaaacagc

SEQ ID NO: 57719 - DNA, 70 bp, Artificial Sequence
  Synthetic
gccaagcatttaggtgacactataggtgcagtgcgaacatccacagtttcagagctatgctggaaacagc

SEQ ID NO: 57720 - DNA, 70 bp, Artificial Sequence
  Synthetic
gccaagcatttaggtgacactatagaagtaggtgatgcccctgaagtttcagagctatgctggaaacagc

SEQ ID NO: 57721 - DNA, 70 bp, Artificial Sequence
  Synthetic
gccaagcatttaggtgacactatagcttgtcagatatgctcaagagtttcagagctatgctggaaacagc

SEQ ID NO: 57722 - DNA, 70 bp, Artificial Sequence
  Synthetic
gccaagcatttaggtgacactataggtcttcaacaattatcgagggtttcagagctatgctggaaacagc

SEQ ID NO: 57723 - DNA, 70 bp, Artificial Sequence
  Synthetic
gccaagcatttaggtgacactatagagtggcccaaactctttattgtttcagagctatgctggaaacagc

SEQ ID NO: 57724 - DNA, 70 bp, Artificial Sequence
  Synthetic
gccaagcatttaggtgacactatagtcacaaatatgcgaagagccgtttcagagctatgctggaaacagc

SEQ ID NO: 57725 - DNA, 70 bp, Artificial Sequence
  Synthetic
gccaagcatttaggtgacactatagtttgatagctgctctaagctgtttcagagctatgctggaaacagc

SEQ ID NO: 57726 - DNA, 70 bp, Artificial Sequence
  Synthetic
gccaagcatttaggtgacactatagctgcaacaagcctgaaaattgtttcagagctatgctggaaacagc

SEQ ID NO: 57727 - DNA, 70 bp, Artificial Sequence
  Synthetic
gccaagcatttaggtgacactatagacatcctcatcaactctcaggtttcagagctatgctggaaacagc

SEQ ID NO: 57728 - DNA, 70 bp, Artificial Sequence
  Synthetic
gccaagcatttaggtgacactataggatccctctgagagttgatggtttcagagctatgctggaaacagc

SEQ ID NO: 57729 - DNA, 70 bp, Artificial Sequence
  Synthetic
gccaagcatttaggtgacactatagcattattttggtgtaggtgggtttcagagctatgctggaaacagc

SEQ ID NO: 57730 - DNA, 70 bp, Artificial Sequence
  Synthetic
gccaagcatttaggtgacactatagggcatagtggctgccctgctgtttcagagctatgctggaaacagc

SEQ ID NO: 57731 - DNA, 70 bp, Artificial Sequence
  Synthetic
gccaagcatttaggtgacactatagaacaaactttcacagactgagtttcagagctatgctggaaacagc

SEQ ID NO: 57732 - DNA, 70 bp, Artificial Sequence
  Synthetic
gccaagcatttaggtgacactatagccagaaggaggacttataatgtttcagagctatgctggaaacagc

SEQ ID NO: 57733 - DNA, 70 bp, Artificial Sequence
  Synthetic
gccaagcatttaggtgacactatagaaaagtttgactgatgactcgtttcagagctatgctggaaacagc

SEQ ID NO: 57734 - DNA, 70 bp, Artificial Sequence
  Synthetic
gccaagcatttaggtgacactataggaggcgatgggtcatgttacgtttcagagctatgctggaaacagc

SEQ ID NO: 57735 - DNA, 70 bp, Artificial Sequence
  Synthetic
gccaagcatttaggtgacactataggctggtcatttcctttgcaagtttcagagctatgctggaaacagc

SEQ ID NO: 57736 - DNA, 70 bp, Artificial Sequence
  Synthetic
gccaagcatttaggtgacactatagtgagttgggtgaatacaagagtttcagagctatgctggaaacagc

SEQ ID NO: 57737 - DNA, 70 bp, Artificial Sequence
  Synthetic
gccaagcatttaggtgacactataggaaatcactgctgcttcttcgtttcagagctatgctggaaacagc

SEQ ID NO: 57738 - DNA, 70 bp, Artificial Sequence
  Synthetic
gccaagcatttaggtgacactatagaaggaggggcttagtttttcgtttcagagctatgctggaaacagc

SEQ ID NO: 57739 - DNA, 70 bp, Artificial Sequence
  Synthetic
gccaagcatttaggtgacactatagcgaaccctgcctccctaggcgtttcagagctatgctggaaacagc

SEQ ID NO: 57740 - DNA, 70 bp, Artificial Sequence
  Synthetic
gccaagcatttaggtgacactatagtggatctcacttcctcaaccgtttcagagctatgctggaaacagc

SEQ ID NO: 57741 - DNA, 70 bp, Artificial Sequence
  Synthetic
gccaagcatttaggtgacactatagtctgtccagcaccagctgaggtttcagagctatgctggaaacagc

SEQ ID NO: 57742 - DNA, 70 bp, Artificial Sequence
  Synthetic
gccaagcatttaggtgacactatagtctgtccagcaccagctaaggtttcagagctatgctggaaacagc

SEQ ID NO: 57743 - DNA, 70 bp, Artificial Sequence
  Synthetic
gccaagcatttaggtgacactatagggtttagagatgataccatcgtttcagagctatgctggaaacagc

SEQ ID NO: 57744 - DNA, 70 bp, Artificial Sequence
  Synthetic
gccaagcatttaggtgacactatagacagccaggttggactagttgtttcagagctatgctggaaacagc

SEQ ID NO: 57745 - DNA, 70 bp, Artificial Sequence
  Synthetic
gccaagcatttaggtgacactatagtattttattgctgtggagtcgtttcagagctatgctggaaacagc

SEQ ID NO: 57746 - DNA, 70 bp, Artificial Sequence
  Synthetic
gccaagcatttaggtgacactatagttgtttgcggggcttttaaagtttcagagctatgctggaaacagc

SEQ ID NO: 57747 - DNA, 70 bp, Artificial Sequence
  Synthetic
gccaagcatttaggtgacactatagggagtcactgacaccagagagtttcagagctatgctggaaacagc

SEQ ID NO: 57748 - DNA, 70 bp, Artificial Sequence
  Synthetic
gccaagcatttaggtgacactatagacctcagcctctgaagtagtgtttcagagctatgctggaaacagc

SEQ ID NO: 57749 - DNA, 70 bp, Artificial Sequence
  Synthetic
gccaagcatttaggtgacactatagctcatgaaaggtcaggacttgtttcagagctatgctggaaacagc

SEQ ID NO: 57750 - DNA, 70 bp, Artificial Sequence
  Synthetic
gccaagcatttaggtgacactatagggacacaggttatgaagaaggtttcagagctatgctggaaacagc

SEQ ID NO: 57751 - DNA, 70 bp, Artificial Sequence
  Synthetic
gccaagcatttaggtgacactatagttggtgcgccctcatatctagtttcagagctatgctggaaacagc

SEQ ID NO: 57752 - DNA, 70 bp, Artificial Sequence
  Synthetic
gccaagcatttaggtgacactatagtgggccccacatcatgggaagtttcagagctatgctggaaacagc

SEQ ID NO: 57753 - DNA, 70 bp, Artificial Sequence
  Synthetic
gccaagcatttaggtgacactatagacaaagttcagtcttgtgaagtttcagagctatgctggaaacagc

SEQ ID NO: 57754 - DNA, 70 bp, Artificial Sequence
  Synthetic
gccaagcatttaggtgacactatagtctcttctattcatcctgacgtttcagagctatgctggaaacagc

SEQ ID NO: 57755 - DNA, 70 bp, Artificial Sequence
  Synthetic
gccaagcatttaggtgacactatagcgacctccacgtgtttatacgtttcagagctatgctggaaacagc

SEQ ID NO: 57756 - DNA, 70 bp, Artificial Sequence
  Synthetic
gccaagcatttaggtgacactatagacggggcttaggagaatattgtttcagagctatgctggaaacagc

SEQ ID NO: 57757 - DNA, 70 bp, Artificial Sequence
  Synthetic
gccaagcatttaggtgacactatagccatccgcatcttttcttaagtttcagagctatgctggaaacagc

SEQ ID NO: 57758 - DNA, 70 bp, Artificial Sequence
  Synthetic
gccaagcatttaggtgacactatagttgccagacagctgttactcgtttcagagctatgctggaaacagc

SEQ ID NO: 57759 - DNA, 70 bp, Artificial Sequence
  Synthetic
gccaagcatttaggtgacactatagaggaaaagatatgaatggccgtttcagagctatgctggaaacagc

SEQ ID NO: 57760 - DNA, 70 bp, Artificial Sequence
  Synthetic
gccaagcatttaggtgacactatagccttcaacgacagtattgaggtttcagagctatgctggaaacagc

SEQ ID NO: 57761 - DNA, 70 bp, Artificial Sequence
  Synthetic
gccaagcatttaggtgacactatagaagaagcggaaaactacctagtttcagagctatgctggaaacagc

SEQ ID NO: 57762 - DNA, 70 bp, Artificial Sequence
  Synthetic
gccaagcatttaggtgacactatagagctgtgggagctgctaggggtttcagagctatgctggaaacagc

SEQ ID NO: 57763 - DNA, 70 bp, Artificial Sequence
  Synthetic
gccaagcatttaggtgacactatagttcagtccacctgatgatatgtttcagagctatgctggaaacagc

SEQ ID NO: 57764 - DNA, 70 bp, Artificial Sequence
  Synthetic
gccaagcatttaggtgacactatagttcggggttggtattagacagtttcagagctatgctggaaacagc

SEQ ID NO: 57765 - DNA, 70 bp, Artificial Sequence
  Synthetic
gccaagcatttaggtgacactataggaaaatccgccgggcctgaagtttcagagctatgctggaaacagc

SEQ ID NO: 57766 - DNA, 70 bp, Artificial Sequence
  Synthetic
gccaagcatttaggtgacactatagtttcaatgatcacagaccatgtttcagagctatgctggaaacagc

SEQ ID NO: 57767 - DNA, 70 bp, Artificial Sequence
  Synthetic
gccaagcatttaggtgacactatagagggctgatgttacctctaggtttcagagctatgctggaaacagc

SEQ ID NO: 57768 - DNA, 70 bp, Artificial Sequence
  Synthetic
gccaagcatttaggtgacactatagtggagctgctgggctgttaggtttcagagctatgctggaaacagc

SEQ ID NO: 57769 - DNA, 70 bp, Artificial Sequence
  Synthetic
gccaagcatttaggtgacactatagtccacagccacaaacgtcacgtttcagagctatgctggaaacagc

SEQ ID NO: 57770 - DNA, 70 bp, Artificial Sequence
  Synthetic
gccaagcatttaggtgacactatagtaggattcttcattgcttgagtttcagagctatgctggaaacagc

SEQ ID NO: 57771 - DNA, 70 bp, Artificial Sequence
  Synthetic
gccaagcatttaggtgacactatagcctgcagcccagcagatagtgtttcagagctatgctggaaacagc

SEQ ID NO: 57772 - DNA, 70 bp, Artificial Sequence
  Synthetic
gccaagcatttaggtgacactatagcccagcagttcaggattcatgtttcagagctatgctggaaacagc

SEQ ID NO: 57773 - DNA, 70 bp, Artificial Sequence
  Synthetic
gccaagcatttaggtgacactatagtatttggtgaatcgtgcccagtttcagagctatgctggaaacagc

SEQ ID NO: 57774 - DNA, 70 bp, Artificial Sequence
  Synthetic
gccaagcatttaggtgacactatagttacccggcacagacgctcagtttcagagctatgctggaaacagc

SEQ ID NO: 57775 - DNA, 70 bp, Artificial Sequence
  Synthetic
gccaagcatttaggtgacactataggactaccgaagtatctgatcgtttcagagctatgctggaaacagc

SEQ ID NO: 57776 - DNA, 70 bp, Artificial Sequence
  Synthetic
gccaagcatttaggtgacactatagaggctgtcaggagtcagggcgtttcagagctatgctggaaacagc

SEQ ID NO: 57777 - DNA, 70 bp, Artificial Sequence
  Synthetic
gccaagcatttaggtgacactatagccaaaccctggatgttaagagtttcagagctatgctggaaacagc

SEQ ID NO: 57778 - DNA, 70 bp, Artificial Sequence
  Synthetic
gccaagcatttaggtgacactataggtcgtcacacatttgtgtccgtttcagagctatgctggaaacagc

SEQ ID NO: 57779 - DNA, 70 bp, Artificial Sequence
  Synthetic
gccaagcatttaggtgacactatagagctcagtgcactgattcccgtttcagagctatgctggaaacagc

SEQ ID NO: 57780 - DNA, 70 bp, Artificial Sequence
  Synthetic
gccaagcatttaggtgacactatagggcaacgtggcgggccctaggtttcagagctatgctggaaacagc

SEQ ID NO: 57781 - DNA, 70 bp, Artificial Sequence
  Synthetic
gccaagcatttaggtgacactataggccctcctaagctttaggccgtttcagagctatgctggaaacagc

SEQ ID NO: 57782 - DNA, 70 bp, Artificial Sequence
  Synthetic
gccaagcatttaggtgacactatagcagccactcagctcagagaagtttcagagctatgctggaaacagc

SEQ ID NO: 57783 - DNA, 70 bp, Artificial Sequence
  Synthetic
gccaagcatttaggtgacactatagtcttcacccagttttacctcgtttcagagctatgctggaaacagc

SEQ ID NO: 57784 - DNA, 70 bp, Artificial Sequence
  Synthetic
gccaagcatttaggtgacactatagtgccagaaaccaggacaaaagtttcagagctatgctggaaacagc

SEQ ID NO: 57785 - DNA, 70 bp, Artificial Sequence
  Synthetic
gccaagcatttaggtgacactatagctggagtggggttacagctcgtttcagagctatgctggaaacagc

SEQ ID NO: 57786 - DNA, 70 bp, Artificial Sequence
  Synthetic
gccaagcatttaggtgacactatagtggccgcgggaggacactgagtttcagagctatgctggaaacagc

SEQ ID NO: 57787 - DNA, 70 bp, Artificial Sequence
  Synthetic
gccaagcatttaggtgacactataggaggaacactcagactgaaagtttcagagctatgctggaaacagc

SEQ ID NO: 57788 - DNA, 70 bp, Artificial Sequence
  Synthetic
gccaagcatttaggtgacactatagctcagctacgtgatcacccagtttcagagctatgctggaaacagc

SEQ ID NO: 57789 - DNA, 70 bp, Artificial Sequence
  Synthetic
gccaagcatttaggtgacactatagtgtaagatatgggaggattcgtttcagagctatgctggaaacagc

SEQ ID NO: 57790 - DNA, 70 bp, Artificial Sequence
  Synthetic
gccaagcatttaggtgacactatagagcgacactctagtggtgatgtttcagagctatgctggaaacagc

SEQ ID NO: 57791 - DNA, 70 bp, Artificial Sequence
  Synthetic
gccaagcatttaggtgacactataggggcctcaccaagttctgcagtttcagagctatgctggaaacagc

SEQ ID NO: 57792 - DNA, 70 bp, Artificial Sequence
  Synthetic
gccaagcatttaggtgacactatagcaacaatgaccccacgacacgtttcagagctatgctggaaacagc

SEQ ID NO: 57793 - DNA, 70 bp, Artificial Sequence
  Synthetic
gccaagcatttaggtgacactatagtggaacttgagtagcatttagtttcagagctatgctggaaacagc

SEQ ID NO: 57794 - DNA, 70 bp, Artificial Sequence
  Synthetic
gccaagcatttaggtgacactatagtctgaggctgcttcggctcagtttcagagctatgctggaaacagc

SEQ ID NO: 57795 - DNA, 70 bp, Artificial Sequence
  Synthetic
gccaagcatttaggtgacactatagggcaggtgctaattccagctgtttcagagctatgctggaaacagc

SEQ ID NO: 57796 - DNA, 70 bp, Artificial Sequence
  Synthetic
gccaagcatttaggtgacactatagtggagggtggggagatattagtttcagagctatgctggaaacagc

SEQ ID NO: 57797 - DNA, 70 bp, Artificial Sequence
  Synthetic
gccaagcatttaggtgacactatagccggggcaaactggacgagggtttcagagctatgctggaaacagc

SEQ ID NO: 57798 - DNA, 70 bp, Artificial Sequence
  Synthetic
gccaagcatttaggtgacactatagcaggcaccattgctgttttagtttcagagctatgctggaaacagc

SEQ ID NO: 57799 - DNA, 70 bp, Artificial Sequence
  Synthetic
gccaagcatttaggtgacactatagtggtttctcagatgatcagtgtttcagagctatgctggaaacagc

SEQ ID NO: 57800 - DNA, 70 bp, Artificial Sequence
  Synthetic
gccaagcatttaggtgacactatagtcagaagcccgcagcttagtgtttcagagctatgctggaaacagc

SEQ ID NO: 57801 - DNA, 70 bp, Artificial Sequence
  Synthetic
gccaagcatttaggtgacactatagtcaccaaaacacaaaaggaagtttcagagctatgctggaaacagc

SEQ ID NO: 57802 - DNA, 70 bp, Artificial Sequence
  Synthetic
gccaagcatttaggtgacactatagccttctcttttccagcatgtgtttcagagctatgctggaaacagc

SEQ ID NO: 57803 - DNA, 70 bp, Artificial Sequence
  Synthetic
gccaagcatttaggtgacactataggctgagcaggtagctgctatgtttcagagctatgctggaaacagc

SEQ ID NO: 57804 - DNA, 70 bp, Artificial Sequence
  Synthetic
gccaagcatttaggtgacactatagggcggattcacagacagcccgtttcagagctatgctggaaacagc

SEQ ID NO: 57805 - DNA, 70 bp, Artificial Sequence
  Synthetic
gccaagcatttaggtgacactatagacagtgtcaacaaatgtcacgtttcagagctatgctggaaacagc

SEQ ID NO: 57806 - DNA, 70 bp, Artificial Sequence
  Synthetic
gccaagcatttaggtgacactatagaccggccaatgcattcaggggtttcagagctatgctggaaacagc

SEQ ID NO: 57807 - DNA, 70 bp, Artificial Sequence
  Synthetic
gccaagcatttaggtgacactataggctccctattctgaatattcgtttcagagctatgctggaaacagc

SEQ ID NO: 57808 - DNA, 70 bp, Artificial Sequence
  Synthetic
gccaagcatttaggtgacactataggtggcacctcatttttacacgtttcagagctatgctggaaacagc

SEQ ID NO: 57809 - DNA, 70 bp, Artificial Sequence
  Synthetic
gccaagcatttaggtgacactatagctactgcacatactcagtttgtttcagagctatgctggaaacagc

SEQ ID NO: 57810 - DNA, 70 bp, Artificial Sequence
  Synthetic
gccaagcatttaggtgacactatagtttcttccctcagtctcattgtttcagagctatgctggaaacagc

SEQ ID NO: 57811 - DNA, 70 bp, Artificial Sequence
  Synthetic
gccaagcatttaggtgacactataggctcggccaggctctcagaggtttcagagctatgctggaaacagc

SEQ ID NO: 57812 - DNA, 70 bp, Artificial Sequence
  Synthetic
gccaagcatttaggtgacactataggttggtatagacgagtaagcgtttcagagctatgctggaaacagc

SEQ ID NO: 57813 - DNA, 70 bp, Artificial Sequence
  Synthetic
gccaagcatttaggtgacactatagaagaggcaagataaatgctcgtttcagagctatgctggaaacagc

SEQ ID NO: 57814 - DNA, 70 bp, Artificial Sequence
  Synthetic
gccaagcatttaggtgacactatagactttcacaattgttgcacagtttcagagctatgctggaaacagc

SEQ ID NO: 57815 - DNA, 70 bp, Artificial Sequence
  Synthetic
gccaagcatttaggtgacactatagttactctttccatggcttacgtttcagagctatgctggaaacagc

SEQ ID NO: 57816 - DNA, 70 bp, Artificial Sequence
  Synthetic
gccaagcatttaggtgacactatagatattgccaagaaactgagggtttcagagctatgctggaaacagc

SEQ ID NO: 57817 - DNA, 70 bp, Artificial Sequence
  Synthetic
gccaagcatttaggtgacactatagggccgtcacctatacttctggtttcagagctatgctggaaacagc

SEQ ID NO: 57818 - DNA, 70 bp, Artificial Sequence
  Synthetic
gccaagcatttaggtgacactataggttaaaagtggcttgggcaggtttcagagctatgctggaaacagc

SEQ ID NO: 57819 - DNA, 70 bp, Artificial Sequence
  Synthetic
gccaagcatttaggtgacactatagcagcggtaggctgagctcacgtttcagagctatgctggaaacagc

SEQ ID NO: 57820 - DNA, 70 bp, Artificial Sequence
  Synthetic
gccaagcatttaggtgacactatagcaatgcttcggcttcatttcgtttcagagctatgctggaaacagc

SEQ ID NO: 57821 - DNA, 70 bp, Artificial Sequence
  Synthetic
gccaagcatttaggtgacactatagtaccctgctaaatagtcagagtttcagagctatgctggaaacagc

SEQ ID NO: 57822 - DNA, 70 bp, Artificial Sequence
  Synthetic
gccaagcatttaggtgacactatagtattgtcaggtttcttgctggtttcagagctatgctggaaacagc

SEQ ID NO: 57823 - DNA, 70 bp, Artificial Sequence
  Synthetic
gccaagcatttaggtgacactatagcactagccaggactgttcacgtttcagagctatgctggaaacagc

SEQ ID NO: 57824 - DNA, 70 bp, Artificial Sequence
  Synthetic
gccaagcatttaggtgacactataggtcgcaaggctattgaacgagtttcagagctatgctggaaacagc

SEQ ID NO: 57825 - DNA, 70 bp, Artificial Sequence
  Synthetic
gccaagcatttaggtgacactataggcgcggctcacacgaagatcgtttcagagctatgctggaaacagc

SEQ ID NO: 57826 - DNA, 70 bp, Artificial Sequence
  Synthetic
gccaagcatttaggtgacactataggtttcttgctgacgaccaccgtttcagagctatgctggaaacagc

SEQ ID NO: 57827 - DNA, 70 bp, Artificial Sequence
  Synthetic
gccaagcatttaggtgacactatagcatgtttctgctgttgctgcgtttcagagctatgctggaaacagc

SEQ ID NO: 57828 - DNA, 70 bp, Artificial Sequence
  Synthetic
gccaagcatttaggtgacactataggggtccactggctccactgagtttcagagctatgctggaaacagc

SEQ ID NO: 57829 - DNA, 70 bp, Artificial Sequence
  Synthetic
gccaagcatttaggtgacactatagggcccaccctcgtctagcccgtttcagagctatgctggaaacagc

SEQ ID NO: 57830 - DNA, 70 bp, Artificial Sequence
  Synthetic
gccaagcatttaggtgacactatagccagtcaagctccgctgacagtttcagagctatgctggaaacagc

SEQ ID NO: 57831 - DNA, 70 bp, Artificial Sequence
  Synthetic
gccaagcatttaggtgacactataggaagtgtgtcagccaagaaggtttcagagctatgctggaaacagc

SEQ ID NO: 57832 - DNA, 70 bp, Artificial Sequence
  Synthetic
gccaagcatttaggtgacactatagtgattttcttgatcttcagggtttcagagctatgctggaaacagc

SEQ ID NO: 57833 - DNA, 70 bp, Artificial Sequence
  Synthetic
gccaagcatttaggtgacactatagcatctgtgatcccagcactggtttcagagctatgctggaaacagc

SEQ ID NO: 57834 - DNA, 70 bp, Artificial Sequence
  Synthetic
gccaagcatttaggtgacactatagcaggctgtggcccagtgatggtttcagagctatgctggaaacagc

SEQ ID NO: 57835 - DNA, 70 bp, Artificial Sequence
  Synthetic
gccaagcatttaggtgacactatagtgggagctcaggaccagttagtttcagagctatgctggaaacagc

SEQ ID NO: 57836 - DNA, 70 bp, Artificial Sequence
  Synthetic
gccaagcatttaggtgacactatagcagctgagcaggacttgagggtttcagagctatgctggaaacagc

SEQ ID NO: 57837 - DNA, 70 bp, Artificial Sequence
  Synthetic
gccaagcatttaggtgacactataggtgctgttagctcttgtctcgtttcagagctatgctggaaacagc

SEQ ID NO: 57838 - DNA, 70 bp, Artificial Sequence
  Synthetic
gccaagcatttaggtgacactatagacggccctactggctactacgtttcagagctatgctggaaacagc

SEQ ID NO: 57839 - DNA, 70 bp, Artificial Sequence
  Synthetic
gccaagcatttaggtgacactatagtagagtctaggtgccctcaggtttcagagctatgctggaaacagc

SEQ ID NO: 57840 - DNA, 70 bp, Artificial Sequence
  Synthetic
gccaagcatttaggtgacactatagtgcagtgtggggttactgttgtttcagagctatgctggaaacagc

SEQ ID NO: 57841 - DNA, 70 bp, Artificial Sequence
  Synthetic
gccaagcatttaggtgacactataggtctggaaacaagctggaaagtttcagagctatgctggaaacagc

SEQ ID NO: 57842 - DNA, 70 bp, Artificial Sequence
  Synthetic
gccaagcatttaggtgacactatagtgctgtgaagttctttcttcgtttcagagctatgctggaaacagc

SEQ ID NO: 57843 - DNA, 70 bp, Artificial Sequence
  Synthetic
gccaagcatttaggtgacactatagcaactggagattaaccccatgtttcagagctatgctggaaacagc

SEQ ID NO: 57844 - DNA, 70 bp, Artificial Sequence
  Synthetic
gccaagcatttaggtgacactatagacttcaaaggaagacaaggagtttcagagctatgctggaaacagc

SEQ ID NO: 57845 - DNA, 70 bp, Artificial Sequence
  Synthetic
gccaagcatttaggtgacactataggctgctctgtgcagtccaaagtttcagagctatgctggaaacagc

SEQ ID NO: 57846 - DNA, 70 bp, Artificial Sequence
  Synthetic
gccaagcatttaggtgacactatagccacgggcgccacgcctcaggtttcagagctatgctggaaacagc

SEQ ID NO: 57847 - DNA, 70 bp, Artificial Sequence
  Synthetic
gccaagcatttaggtgacactatagctctcctgaaacttaatgacgtttcagagctatgctggaaacagc

SEQ ID NO: 57848 - DNA, 70 bp, Artificial Sequence
  Synthetic
gccaagcatttaggtgacactataggtcagagttcgtggtggcttgtttcagagctatgctggaaacagc

SEQ ID NO: 57849 - DNA, 70 bp, Artificial Sequence
  Synthetic
gccaagcatttaggtgacactataggaggtgctgctgcagacgtagtttcagagctatgctggaaacagc

SEQ ID NO: 57850 - DNA, 70 bp, Artificial Sequence
  Synthetic
gccaagcatttaggtgacactatagcagacaggccctgcttttctgtttcagagctatgctggaaacagc

SEQ ID NO: 57851 - DNA, 70 bp, Artificial Sequence
  Synthetic
gccaagcatttaggtgacactatagcccgaggggctgctctaggtgtttcagagctatgctggaaacagc

SEQ ID NO: 57852 - DNA, 70 bp, Artificial Sequence
  Synthetic
gccaagcatttaggtgacactatagctcaagctgcgtcctgcgcagtttcagagctatgctggaaacagc

SEQ ID NO: 57853 - DNA, 70 bp, Artificial Sequence
  Synthetic
gccaagcatttaggtgacactatagccagagtcctgtgcagtcacgtttcagagctatgctggaaacagc

SEQ ID NO: 57854 - DNA, 70 bp, Artificial Sequence
  Synthetic
gccaagcatttaggtgacactatagtccactcctctagctcattggtttcagagctatgctggaaacagc

SEQ ID NO: 57855 - DNA, 70 bp, Artificial Sequence
  Synthetic
gccaagcatttaggtgacactatagggcattggctcttgaactgagtttcagagctatgctggaaacagc

SEQ ID NO: 57856 - DNA, 70 bp, Artificial Sequence
  Synthetic
gccaagcatttaggtgacactatagtccaagaagcagtctcacatgtttcagagctatgctggaaacagc

SEQ ID NO: 57857 - DNA, 70 bp, Artificial Sequence
  Synthetic
gccaagcatttaggtgacactatagtgatccatcagctgacatgcgtttcagagctatgctggaaacagc

SEQ ID NO: 57858 - DNA, 70 bp, Artificial Sequence
  Synthetic
gccaagcatttaggtgacactataggcccgcggccaggagtcagcgtttcagagctatgctggaaacagc

SEQ ID NO: 57859 - DNA, 70 bp, Artificial Sequence
  Synthetic
gccaagcatttaggtgacactatagactcaggtcactcagagtgtgtttcagagctatgctggaaacagc

SEQ ID NO: 57860 - DNA, 70 bp, Artificial Sequence
  Synthetic
gccaagcatttaggtgacactatagtccctgcggctcttaggcgagtttcagagctatgctggaaacagc

SEQ ID NO: 57861 - DNA, 70 bp, Artificial Sequence
  Synthetic
gccaagcatttaggtgacactatagccctgatctggaggcctagtgtttcagagctatgctggaaacagc

SEQ ID NO: 57862 - DNA, 70 bp, Artificial Sequence
  Synthetic
gccaagcatttaggtgacactatagtgttatgtccactgggctacgtttcagagctatgctggaaacagc

SEQ ID NO: 57863 - DNA, 70 bp, Artificial Sequence
  Synthetic
gccaagcatttaggtgacactatagccctgggggagctgcagtaggtttcagagctatgctggaaacagc

SEQ ID NO: 57864 - DNA, 70 bp, Artificial Sequence
  Synthetic
gccaagcatttaggtgacactataggtcccacggcagaagccctggtttcagagctatgctggaaacagc

SEQ ID NO: 57865 - DNA, 70 bp, Artificial Sequence
  Synthetic
gccaagcatttaggtgacactataggctctcttggtgccacctccgtttcagagctatgctggaaacagc

SEQ ID NO: 57866 - DNA, 70 bp, Artificial Sequence
  Synthetic
gccaagcatttaggtgacactatagatgcagtctgactcgtgcttgtttcagagctatgctggaaacagc

SEQ ID NO: 57867 - DNA, 70 bp, Artificial Sequence
  Synthetic
gccaagcatttaggtgacactataggaatagtgaacgtaaacggagtttcagagctatgctggaaacagc

SEQ ID NO: 57868 - DNA, 70 bp, Artificial Sequence
  Synthetic
gccaagcatttaggtgacactatagtagtgaaggagagcgatctggtttcagagctatgctggaaacagc

SEQ ID NO: 57869 - DNA, 70 bp, Artificial Sequence
  Synthetic
gccaagcatttaggtgacactatagtacccacatccaacggtcacgtttcagagctatgctggaaacagc

SEQ ID NO: 57870 - DNA, 70 bp, Artificial Sequence
  Synthetic
gccaagcatttaggtgacactatagaggccaccatcaactggaatgtttcagagctatgctggaaacagc

SEQ ID NO: 57871 - DNA, 70 bp, Artificial Sequence
  Synthetic
gccaagcatttaggtgacactatagtgcatcatgaactggtgacggtttcagagctatgctggaaacagc

SEQ ID NO: 57872 - DNA, 70 bp, Artificial Sequence
  Synthetic
gccaagcatttaggtgacactatagaatgcaggggttgggaatgggtttcagagctatgctggaaacagc

SEQ ID NO: 57873 - DNA, 70 bp, Artificial Sequence
  Synthetic
gccaagcatttaggtgacactatagccacaatcagctctgatgccgtttcagagctatgctggaaacagc

SEQ ID NO: 57874 - DNA, 70 bp, Artificial Sequence
  Synthetic
gccaagcatttaggtgacactatagtggaaaatatgtcaaagagcgtttcagagctatgctggaaacagc

SEQ ID NO: 57875 - DNA, 70 bp, Artificial Sequence
  Synthetic
gccaagcatttaggtgacactatagtgctaattcacattcttcacgtttcagagctatgctggaaacagc

SEQ ID NO: 57876 - DNA, 70 bp, Artificial Sequence
  Synthetic
gccaagcatttaggtgacactatagttgtaattgtacgctgttaggtttcagagctatgctggaaacagc

SEQ ID NO: 57877 - DNA, 70 bp, Artificial Sequence
  Synthetic
gccaagcatttaggtgacactatagaggtggtaacattttatggcgtttcagagctatgctggaaacagc

SEQ ID NO: 57878 - DNA, 70 bp, Artificial Sequence
  Synthetic
gccaagcatttaggtgacactatagggcaggagggtcaccagctcgtttcagagctatgctggaaacagc

SEQ ID NO: 57879 - DNA, 70 bp, Artificial Sequence
  Synthetic
gccaagcatttaggtgacactatagtattcagctggagcttctacgtttcagagctatgctggaaacagc

SEQ ID NO: 57880 - DNA, 70 bp, Artificial Sequence
  Synthetic
gccaagcatttaggtgacactatagggacttcgaaactttcctcagtttcagagctatgctggaaacagc

SEQ ID NO: 57881 - DNA, 70 bp, Artificial Sequence
  Synthetic
gccaagcatttaggtgacactatagcaatcagatcactgtcctcagtttcagagctatgctggaaacagc

SEQ ID NO: 57882 - DNA, 70 bp, Artificial Sequence
  Synthetic
gccaagcatttaggtgacactatagtggctggagccactgctgaagtttcagagctatgctggaaacagc

SEQ ID NO: 57883 - DNA, 70 bp, Artificial Sequence
  Synthetic
gccaagcatttaggtgacactatagacagaacattagagacaatggtttcagagctatgctggaaacagc

SEQ ID NO: 57884 - DNA, 70 bp, Artificial Sequence
  Synthetic
gccaagcatttaggtgacactatagtagagttcagcttttacaaggtttcagagctatgctggaaacagc

SEQ ID NO: 57885 - DNA, 70 bp, Artificial Sequence
  Synthetic
gccaagcatttaggtgacactatagttaggagaaaactctggtatgtttcagagctatgctggaaacagc

SEQ ID NO: 57886 - DNA, 70 bp, Artificial Sequence
  Synthetic
gccaagcatttaggtgacactatagccgcatctacgccagtgagggtttcagagctatgctggaaacagc

SEQ ID NO: 57887 - DNA, 70 bp, Artificial Sequence
  Synthetic
gccaagcatttaggtgacactatagcaggaggagcgcaaaccttggtttcagagctatgctggaaacagc

SEQ ID NO: 57888 - DNA, 70 bp, Artificial Sequence
  Synthetic
gccaagcatttaggtgacactatagtctactgttgtttcatgacagtttcagagctatgctggaaacagc

SEQ ID NO: 57889 - DNA, 70 bp, Artificial Sequence
  Synthetic
gccaagcatttaggtgacactatagtggatgattaagattggaaggtttcagagctatgctggaaacagc

SEQ ID NO: 57890 - DNA, 70 bp, Artificial Sequence
  Synthetic
gccaagcatttaggtgacactatagcagtatgagcatggaagagagtttcagagctatgctggaaacagc

SEQ ID NO: 57891 - DNA, 70 bp, Artificial Sequence
  Synthetic
gccaagcatttaggtgacactataggttaagcgtaagcatagccagtttcagagctatgctggaaacagc

SEQ ID NO: 57892 - DNA, 70 bp, Artificial Sequence
  Synthetic
gccaagcatttaggtgacactatagtctgcctttggtaacttttggtttcagagctatgctggaaacagc

SEQ ID NO: 57893 - DNA, 70 bp, Artificial Sequence
  Synthetic
gccaagcatttaggtgacactatagttcactgtccctatgacttcgtttcagagctatgctggaaacagc

SEQ ID NO: 57894 - DNA, 70 bp, Artificial Sequence
  Synthetic
gccaagcatttaggtgacactatagagagacagccaatttgatttgtttcagagctatgctggaaacagc

SEQ ID NO: 57895 - DNA, 70 bp, Artificial Sequence
  Synthetic
gccaagcatttaggtgacactatagtgagccagagagctacaagcgtttcagagctatgctggaaacagc

SEQ ID NO: 57896 - DNA, 70 bp, Artificial Sequence
  Synthetic
gccaagcatttaggtgacactataggcctgggggagctcagcagagtttcagagctatgctggaaacagc

SEQ ID NO: 57897 - DNA, 70 bp, Artificial Sequence
  Synthetic
gccaagcatttaggtgacactatagaatctgtgacgttagtcccagtttcagagctatgctggaaacagc

SEQ ID NO: 57898 - DNA, 70 bp, Artificial Sequence
  Synthetic
gccaagcatttaggtgacactatagtcttcagttacagtgtgatggtttcagagctatgctggaaacagc

SEQ ID NO: 57899 - DNA, 70 bp, Artificial Sequence
  Synthetic
gccaagcatttaggtgacactatagcctgacgctcttcgcagctggtttcagagctatgctggaaacagc

SEQ ID NO: 57900 - DNA, 70 bp, Artificial Sequence
  Synthetic
gccaagcatttaggtgacactatagtggagcatttcagagtgctggtttcagagctatgctggaaacagc

SEQ ID NO: 57901 - DNA, 70 bp, Artificial Sequence
  Synthetic
gccaagcatttaggtgacactatagggagatgggagggtcaggcggtttcagagctatgctggaaacagc

SEQ ID NO: 57902 - DNA, 70 bp, Artificial Sequence
  Synthetic
gccaagcatttaggtgacactatagtcttcactcattcacagtaagtttcagagctatgctggaaacagc

SEQ ID NO: 57903 - DNA, 70 bp, Artificial Sequence
  Synthetic
gccaagcatttaggtgacactatagggacttgtttcatgatgagcgtttcagagctatgctggaaacagc

SEQ ID NO: 57904 - DNA, 70 bp, Artificial Sequence
  Synthetic
gccaagcatttaggtgacactatagtcaagtgcattcgcaagtgggtttcagagctatgctggaaacagc

SEQ ID NO: 57905 - DNA, 70 bp, Artificial Sequence
  Synthetic
gccaagcatttaggtgacactatagcttcatgcacctttctggaggtttcagagctatgctggaaacagc

SEQ ID NO: 57906 - DNA, 70 bp, Artificial Sequence
  Synthetic
gccaagcatttaggtgacactataggcacaaccccctgagggcgggtttcagagctatgctggaaacagc

SEQ ID NO: 57907 - DNA, 70 bp, Artificial Sequence
  Synthetic
gccaagcatttaggtgacactatagggacttgcttcattatgagcgtttcagagctatgctggaaacagc

SEQ ID NO: 57908 - DNA, 70 bp, Artificial Sequence
  Synthetic
gccaagcatttaggtgacactatagcattgtgaatggaactctgcgtttcagagctatgctggaaacagc

SEQ ID NO: 57909 - DNA, 70 bp, Artificial Sequence
  Synthetic
gccaagcatttaggtgacactatagctctaatcagaaagacgaaggtttcagagctatgctggaaacagc

SEQ ID NO: 57910 - DNA, 70 bp, Artificial Sequence
  Synthetic
gccaagcatttaggtgacactatagctgctgtgagctaggagaccgtttcagagctatgctggaaacagc

SEQ ID NO: 57911 - DNA, 70 bp, Artificial Sequence
  Synthetic
gccaagcatttaggtgacactatagtcttaaaactgctgcaccaggtttcagagctatgctggaaacagc

SEQ ID NO: 57912 - DNA, 70 bp, Artificial Sequence
  Synthetic
gccaagcatttaggtgacactataggctggctcttaaggtgaatagtttcagagctatgctggaaacagc

SEQ ID NO: 57913 - DNA, 70 bp, Artificial Sequence
  Synthetic
gccaagcatttaggtgacactatagtttccgcgtctgggggtcacgtttcagagctatgctggaaacagc

SEQ ID NO: 57914 - DNA, 70 bp, Artificial Sequence
  Synthetic
gccaagcatttaggtgacactatagtagtcatttgttctcacaacgtttcagagctatgctggaaacagc

SEQ ID NO: 57915 - DNA, 70 bp, Artificial Sequence
  Synthetic
gccaagcatttaggtgacactatagggggacaaactccacatcaagtttcagagctatgctggaaacagc

SEQ ID NO: 57916 - DNA, 70 bp, Artificial Sequence
  Synthetic
gccaagcatttaggtgacactatagcccgccgctatgactggtgagtttcagagctatgctggaaacagc

SEQ ID NO: 57917 - DNA, 70 bp, Artificial Sequence
  Synthetic
gccaagcatttaggtgacactatagagactttgtatagatcaggcgtttcagagctatgctggaaacagc

SEQ ID NO: 57918 - DNA, 70 bp, Artificial Sequence
  Synthetic
gccaagcatttaggtgacactatagcagtgattctgttctcatgggtttcagagctatgctggaaacagc

SEQ ID NO: 57919 - DNA, 70 bp, Artificial Sequence
  Synthetic
gccaagcatttaggtgacactataggaatcaagagcttcatgttcgtttcagagctatgctggaaacagc

SEQ ID NO: 57920 - DNA, 70 bp, Artificial Sequence
  Synthetic
gccaagcatttaggtgacactatagtagggttcctcaatgatcaggtttcagagctatgctggaaacagc

SEQ ID NO: 57921 - DNA, 70 bp, Artificial Sequence
  Synthetic
gccaagcatttaggtgacactatagtccctctgtgcggccctctggtttcagagctatgctggaaacagc

SEQ ID NO: 57922 - DNA, 70 bp, Artificial Sequence
  Synthetic
gccaagcatttaggtgacactataggcacgcggcccagggtcatggtttcagagctatgctggaaacagc

SEQ ID NO: 57923 - DNA, 70 bp, Artificial Sequence
  Synthetic
gccaagcatttaggtgacactatagcaacttttctcttgagctacgtttcagagctatgctggaaacagc

SEQ ID NO: 57924 - DNA, 70 bp, Artificial Sequence
  Synthetic
gccaagcatttaggtgacactatagggcgtttcaagaaggagagggtttcagagctatgctggaaacagc

SEQ ID NO: 57925 - DNA, 70 bp, Artificial Sequence
  Synthetic
gccaagcatttaggtgacactatagtctgacttgcattatctccagtttcagagctatgctggaaacagc

SEQ ID NO: 57926 - DNA, 70 bp, Artificial Sequence
  Synthetic
gccaagcatttaggtgacactatagttactggcgtgttccaaagagtttcagagctatgctggaaacagc

SEQ ID NO: 57927 - DNA, 70 bp, Artificial Sequence
  Synthetic
gccaagcatttaggtgacactataggaaacatctggaacatcctggtttcagagctatgctggaaacagc

SEQ ID NO: 57928 - DNA, 70 bp, Artificial Sequence
  Synthetic
gccaagcatttaggtgacactataggcctcagccaaccaggaaaagtttcagagctatgctggaaacagc

SEQ ID NO: 57929 - DNA, 70 bp, Artificial Sequence
  Synthetic
gccaagcatttaggtgacactatagtccccagcgtggccatcactgtttcagagctatgctggaaacagc

SEQ ID NO: 57930 - DNA, 70 bp, Artificial Sequence
  Synthetic
gccaagcatttaggtgacactatagagcgctaacgtgaagacgatgtttcagagctatgctggaaacagc

SEQ ID NO: 57931 - DNA, 70 bp, Artificial Sequence
  Synthetic
gccaagcatttaggtgacactatagggtggcccaccagtcctaacgtttcagagctatgctggaaacagc

SEQ ID NO: 57932 - DNA, 70 bp, Artificial Sequence
  Synthetic
gccaagcatttaggtgacactataggccttcaatgacagtgtgctgtttcagagctatgctggaaacagc

SEQ ID NO: 57933 - DNA, 70 bp, Artificial Sequence
  Synthetic
gccaagcatttaggtgacactataggaaaaaccagctttactgacgtttcagagctatgctggaaacagc

SEQ ID NO: 57934 - DNA, 70 bp, Artificial Sequence
  Synthetic
gccaagcatttaggtgacactatagaccaggattggcaagagattgtttcagagctatgctggaaacagc

SEQ ID NO: 57935 - DNA, 70 bp, Artificial Sequence
  Synthetic
gccaagcatttaggtgacactataggggtctggccaggactataagtttcagagctatgctggaaacagc

SEQ ID NO: 57936 - DNA, 70 bp, Artificial Sequence
  Synthetic
gccaagcatttaggtgacactataggcttgctgttcttttgaaacgtttcagagctatgctggaaacagc

SEQ ID NO: 57937 - DNA, 70 bp, Artificial Sequence
  Synthetic
gccaagcatttaggtgacactatagaagaagtctgctgctagtccgtttcagagctatgctggaaacagc

SEQ ID NO: 57938 - DNA, 70 bp, Artificial Sequence
  Synthetic
gccaagcatttaggtgacactataggacccatcggccgagtctgagtttcagagctatgctggaaacagc

SEQ ID NO: 57939 - DNA, 70 bp, Artificial Sequence
  Synthetic
gccaagcatttaggtgacactatagtccacatgggagaaaatcaagtttcagagctatgctggaaacagc

SEQ ID NO: 57940 - DNA, 70 bp, Artificial Sequence
  Synthetic
gccaagcatttaggtgacactatagttcttcataatatggctgtcgtttcagagctatgctggaaacagc

SEQ ID NO: 57941 - DNA, 70 bp, Artificial Sequence
  Synthetic
gccaagcatttaggtgacactataggaagtcctacggactttatggtttcagagctatgctggaaacagc

SEQ ID NO: 57942 - DNA, 70 bp, Artificial Sequence
  Synthetic
gccaagcatttaggtgacactatagcaagtctgggtcacctcattgtttcagagctatgctggaaacagc

SEQ ID NO: 57943 - DNA, 70 bp, Artificial Sequence
  Synthetic
gccaagcatttaggtgacactataggacttgtctaaagaggcagtgtttcagagctatgctggaaacagc

SEQ ID NO: 57944 - DNA, 70 bp, Artificial Sequence
  Synthetic
gccaagcatttaggtgacactatagcttttgaagatcaccaaaccgtttcagagctatgctggaaacagc

SEQ ID NO: 57945 - DNA, 70 bp, Artificial Sequence
  Synthetic
gccaagcatttaggtgacactatagagggccttggctaccacacggtttcagagctatgctggaaacagc

SEQ ID NO: 57946 - DNA, 70 bp, Artificial Sequence
  Synthetic
gccaagcatttaggtgacactatagtgttagaggacaatgcatctgtttcagagctatgctggaaacagc

SEQ ID NO: 57947 - DNA, 70 bp, Artificial Sequence
  Synthetic
gccaagcatttaggtgacactatagctaatagctggttcaactgcgtttcagagctatgctggaaacagc

SEQ ID NO: 57948 - DNA, 70 bp, Artificial Sequence
  Synthetic
gccaagcatttaggtgacactatagtaacagctggttacattgctgtttcagagctatgctggaaacagc

SEQ ID NO: 57949 - DNA, 70 bp, Artificial Sequence
  Synthetic
gccaagcatttaggtgacactatagggcatccaagccatggtcaggtttcagagctatgctggaaacagc

SEQ ID NO: 57950 - DNA, 70 bp, Artificial Sequence
  Synthetic
gccaagcatttaggtgacactatagctgaaaagcaatagctggttgtttcagagctatgctggaaacagc

SEQ ID NO: 57951 - DNA, 70 bp, Artificial Sequence
  Synthetic
gccaagcatttaggtgacactatagagacacttaacaccacaaaagtttcagagctatgctggaaacagc

SEQ ID NO: 57952 - DNA, 70 bp, Artificial Sequence
  Synthetic
gccaagcatttaggtgacactatagccagcgttccctgctggacagtttcagagctatgctggaaacagc

SEQ ID NO: 57953 - DNA, 70 bp, Artificial Sequence
  Synthetic
gccaagcatttaggtgacactatagcaagcgctcgctgcaggagtgtttcagagctatgctggaaacagc

SEQ ID NO: 57954 - DNA, 70 bp, Artificial Sequence
  Synthetic
gccaagcatttaggtgacactatagtaaacgctctatgcaagagtgtttcagagctatgctggaaacagc

SEQ ID NO: 57955 - DNA, 70 bp, Artificial Sequence
  Synthetic
gccaagcatttaggtgacactataggcgctgtgtgtcatagcgtcgtttcagagctatgctggaaacagc

SEQ ID NO: 57956 - DNA, 70 bp, Artificial Sequence
  Synthetic
gccaagcatttaggtgacactataggagcagtcagtattcaaacggtttcagagctatgctggaaacagc

SEQ ID NO: 57957 - DNA, 70 bp, Artificial Sequence
  Synthetic
gccaagcatttaggtgacactatagtctactcgcctcgaacacaagtttcagagctatgctggaaacagc

SEQ ID NO: 57958 - DNA, 70 bp, Artificial Sequence
  Synthetic
gccaagcatttaggtgacactataggactggctaggctgctgagcgtttcagagctatgctggaaacagc

SEQ ID NO: 57959 - DNA, 70 bp, Artificial Sequence
  Synthetic
gccaagcatttaggtgacactatagttctatttagcaaccaatccgtttcagagctatgctggaaacagc

SEQ ID NO: 57960 - DNA, 70 bp, Artificial Sequence
  Synthetic
gccaagcatttaggtgacactatagacatgttcagtgtggagatagtttcagagctatgctggaaacagc

SEQ ID NO: 57961 - DNA, 70 bp, Artificial Sequence
  Synthetic
gccaagcatttaggtgacactatagtcctggcgagtccgtgtgcggtttcagagctatgctggaaacagc

SEQ ID NO: 57962 - DNA, 70 bp, Artificial Sequence
  Synthetic
gccaagcatttaggtgacactataggggctgctcacacccattccgtttcagagctatgctggaaacagc

SEQ ID NO: 57963 - DNA, 70 bp, Artificial Sequence
  Synthetic
gccaagcatttaggtgacactatagggtgtagcctcccgctgatggtttcagagctatgctggaaacagc

SEQ ID NO: 57964 - DNA, 70 bp, Artificial Sequence
  Synthetic
gccaagcatttaggtgacactatagcaaaggatccagcatttgtagtttcagagctatgctggaaacagc

SEQ ID NO: 57965 - DNA, 70 bp, Artificial Sequence
  Synthetic
gccaagcatttaggtgacactatagaaggaaaaagcacattcagggtttcagagctatgctggaaacagc

SEQ ID NO: 57966 - DNA, 70 bp, Artificial Sequence
  Synthetic
gccaagcatttaggtgacactatagaagaaacgctttgcaaagcagtttcagagctatgctggaaacagc

SEQ ID NO: 57967 - DNA, 70 bp, Artificial Sequence
  Synthetic
gccaagcatttaggtgacactatagcggggagcgccctgttctgagtttcagagctatgctggaaacagc

SEQ ID NO: 57968 - DNA, 70 bp, Artificial Sequence
  Synthetic
gccaagcatttaggtgacactataggcggcagtgtcattgaatgagtttcagagctatgctggaaacagc

SEQ ID NO: 57969 - DNA, 70 bp, Artificial Sequence
  Synthetic
gccaagcatttaggtgacactatagacactttgaagagtaacagcgtttcagagctatgctggaaacagc

SEQ ID NO: 57970 - DNA, 70 bp, Artificial Sequence
  Synthetic
gccaagcatttaggtgacactatagatgtatccaacctatggaaagtttcagagctatgctggaaacagc

SEQ ID NO: 57971 - DNA, 70 bp, Artificial Sequence
  Synthetic
gccaagcatttaggtgacactataggagttgcaagaggcaataaagtttcagagctatgctggaaacagc

SEQ ID NO: 57972 - DNA, 70 bp, Artificial Sequence
  Synthetic
gccaagcatttaggtgacactatagctgcagtgccctgaggactagtttcagagctatgctggaaacagc

SEQ ID NO: 57973 - DNA, 70 bp, Artificial Sequence
  Synthetic
gccaagcatttaggtgacactatagccccctgttactacatttaggtttcagagctatgctggaaacagc

SEQ ID NO: 57974 - DNA, 70 bp, Artificial Sequence
  Synthetic
gccaagcatttaggtgacactataggggttcaggtcttaaacatcgtttcagagctatgctggaaacagc

SEQ ID NO: 57975 - DNA, 70 bp, Artificial Sequence
  Synthetic
gccaagcatttaggtgacactatagggactgagggctcagctgccgtttcagagctatgctggaaacagc

SEQ ID NO: 57976 - DNA, 70 bp, Artificial Sequence
  Synthetic
gccaagcatttaggtgacactatagacaagatgagatgcagagacgtttcagagctatgctggaaacagc

SEQ ID NO: 57977 - DNA, 70 bp, Artificial Sequence
  Synthetic
gccaagcatttaggtgacactatagcaacagatttgggacattcggtttcagagctatgctggaaacagc

SEQ ID NO: 57978 - DNA, 70 bp, Artificial Sequence
  Synthetic
gccaagcatttaggtgacactatagatgcattcagtgggcttttcgtttcagagctatgctggaaacagc

SEQ ID NO: 57979 - DNA, 70 bp, Artificial Sequence
  Synthetic
gccaagcatttaggtgacactatagtaaaattggccgatgtgaaagtttcagagctatgctggaaacagc

SEQ ID NO: 57980 - DNA, 70 bp, Artificial Sequence
  Synthetic
gccaagcatttaggtgacactatagtctatgtagtcaaagtcttcgtttcagagctatgctggaaacagc

SEQ ID NO: 57981 - DNA, 70 bp, Artificial Sequence
  Synthetic
gccaagcatttaggtgacactatagaaggccaagaaaaacaaggagtttcagagctatgctggaaacagc

SEQ ID NO: 57982 - DNA, 70 bp, Artificial Sequence
  Synthetic
gccaagcatttaggtgacactatagatctgcttggtgaagagttcgtttcagagctatgctggaaacagc

SEQ ID NO: 57983 - DNA, 70 bp, Artificial Sequence
  Synthetic
gccaagcatttaggtgacactatagagcacactcaagctggcttggtttcagagctatgctggaaacagc

SEQ ID NO: 57984 - DNA, 70 bp, Artificial Sequence
  Synthetic
gccaagcatttaggtgacactatagctgggccgcggggctcctacgtttcagagctatgctggaaacagc

SEQ ID NO: 57985 - DNA, 70 bp, Artificial Sequence
  Synthetic
gccaagcatttaggtgacactatagcttctccaggcaatattggagtttcagagctatgctggaaacagc

SEQ ID NO: 57986 - DNA, 70 bp, Artificial Sequence
  Synthetic
gccaagcatttaggtgacactatagtctgattgataggcgtgagcgtttcagagctatgctggaaacagc

SEQ ID NO: 57987 - DNA, 70 bp, Artificial Sequence
  Synthetic
gccaagcatttaggtgacactatagtttggtgcagaacatttgatgtttcagagctatgctggaaacagc

SEQ ID NO: 57988 - DNA, 70 bp, Artificial Sequence
  Synthetic
gccaagcatttaggtgacactatagataacgtctcatcatccaacgtttcagagctatgctggaaacagc

SEQ ID NO: 57989 - DNA, 70 bp, Artificial Sequence
  Synthetic
gccaagcatttaggtgacactatagttttcaatcagttcttggaggtttcagagctatgctggaaacagc

SEQ ID NO: 57990 - DNA, 70 bp, Artificial Sequence
  Synthetic
gccaagcatttaggtgacactatagaacagatgaactaaggtaaggtttcagagctatgctggaaacagc

SEQ ID NO: 57991 - DNA, 70 bp, Artificial Sequence
  Synthetic
gccaagcatttaggtgacactataggggctcatctctccttcacggtttcagagctatgctggaaacagc

SEQ ID NO: 57992 - DNA, 70 bp, Artificial Sequence
  Synthetic
gccaagcatttaggtgacactataggagacccgcggggctctcaggtttcagagctatgctggaaacagc

SEQ ID NO: 57993 - DNA, 70 bp, Artificial Sequence
  Synthetic
gccaagcatttaggtgacactataggatgaacctcatagaccgcagtttcagagctatgctggaaacagc

SEQ ID NO: 57994 - DNA, 70 bp, Artificial Sequence
  Synthetic
gccaagcatttaggtgacactatagaagtccagacctgggctcaggtttcagagctatgctggaaacagc

SEQ ID NO: 57995 - DNA, 70 bp, Artificial Sequence
  Synthetic
gccaagcatttaggtgacactatagtggggaaagtgaagcatgaagtttcagagctatgctggaaacagc

SEQ ID NO: 57996 - DNA, 70 bp, Artificial Sequence
  Synthetic
gccaagcatttaggtgacactatagccgtcaaagcttctaggttcgtttcagagctatgctggaaacagc

SEQ ID NO: 57997 - DNA, 70 bp, Artificial Sequence
  Synthetic
gccaagcatttaggtgacactataggagctcagcaacagcatgccgtttcagagctatgctggaaacagc

SEQ ID NO: 57998 - DNA, 70 bp, Artificial Sequence
  Synthetic
gccaagcatttaggtgacactatagggtcccccgtcaaagcttctgtttcagagctatgctggaaacagc

SEQ ID NO: 57999 - DNA, 70 bp, Artificial Sequence
  Synthetic
gccaagcatttaggtgacactatagttttttaggaggtaacatccgtttcagagctatgctggaaacagc

SEQ ID NO: 58000 - DNA, 70 bp, Artificial Sequence
  Synthetic
gccaagcatttaggtgacactatagggcccatgatcctcatcggtgtttcagagctatgctggaaacagc

SEQ ID NO: 58001 - DNA, 70 bp, Artificial Sequence
  Synthetic
gccaagcatttaggtgacactatagaggaaacaaagagtgcttttgtttcagagctatgctggaaacagc

SEQ ID NO: 58002 - DNA, 70 bp, Artificial Sequence
  Synthetic
gccaagcatttaggtgacactatagggaacatttccacagtactggtttcagagctatgctggaaacagc

SEQ ID NO: 58003 - DNA, 70 bp, Artificial Sequence
  Synthetic
gccaagcatttaggtgacactatagggatggtctctgccatgaacgtttcagagctatgctggaaacagc

SEQ ID NO: 58004 - DNA, 70 bp, Artificial Sequence
  Synthetic
gccaagcatttaggtgacactatagaagatgtgacatcactcagagtttcagagctatgctggaaacagc

SEQ ID NO: 58005 - DNA, 70 bp, Artificial Sequence
  Synthetic
gccaagcatttaggtgacactatagctggaagccctctctggctagtttcagagctatgctggaaacagc

SEQ ID NO: 58006 - DNA, 70 bp, Artificial Sequence
  Synthetic
gccaagcatttaggtgacactatagaaaacaagagtctcgtgctcgtttcagagctatgctggaaacagc

SEQ ID NO: 58007 - DNA, 70 bp, Artificial Sequence
  Synthetic
gccaagcatttaggtgacactatagctcagcagaactccaagtgcgtttcagagctatgctggaaacagc

SEQ ID NO: 58008 - DNA, 70 bp, Artificial Sequence
  Synthetic
gccaagcatttaggtgacactatagcacctgcctcaccttcatctgtttcagagctatgctggaaacagc

SEQ ID NO: 58009 - DNA, 70 bp, Artificial Sequence
  Synthetic
gccaagcatttaggtgacactataggggctcaggggctcagcgaagtttcagagctatgctggaaacagc

SEQ ID NO: 58010 - DNA, 70 bp, Artificial Sequence
  Synthetic
gccaagcatttaggtgacactatagcatggctgaagactactgaagtttcagagctatgctggaaacagc

SEQ ID NO: 58011 - DNA, 70 bp, Artificial Sequence
  Synthetic
gccaagcatttaggtgacactatagcccaccatagtgcggaaagggtttcagagctatgctggaaacagc

SEQ ID NO: 58012 - DNA, 70 bp, Artificial Sequence
  Synthetic
gccaagcatttaggtgacactatagcacgcccctcacctattgatgtttcagagctatgctggaaacagc

SEQ ID NO: 58013 - DNA, 70 bp, Artificial Sequence
  Synthetic
gccaagcatttaggtgacactataggcccataatggcttgttcacgtttcagagctatgctggaaacagc

SEQ ID NO: 58014 - DNA, 70 bp, Artificial Sequence
  Synthetic
gccaagcatttaggtgacactatagaacaaggtttaaaagtaggggtttcagagctatgctggaaacagc

SEQ ID NO: 58015 - DNA, 70 bp, Artificial Sequence
  Synthetic
gccaagcatttaggtgacactatagtcaaaatggagaatcttgacgtttcagagctatgctggaaacagc

SEQ ID NO: 58016 - DNA, 70 bp, Artificial Sequence
  Synthetic
gccaagcatttaggtgacactatagaataagtgtcagtctgctccgtttcagagctatgctggaaacagc

SEQ ID NO: 58017 - DNA, 70 bp, Artificial Sequence
  Synthetic
gccaagcatttaggtgacactatagtcatcaccaagggggactgagtttcagagctatgctggaaacagc

SEQ ID NO: 58018 - DNA, 70 bp, Artificial Sequence
  Synthetic
gccaagcatttaggtgacactatagacttgctgaagatcaagatcgtttcagagctatgctggaaacagc

SEQ ID NO: 58019 - DNA, 70 bp, Artificial Sequence
  Synthetic
gccaagcatttaggtgacactataggctggaggcaaatcacatacgtttcagagctatgctggaaacagc

SEQ ID NO: 58020 - DNA, 70 bp, Artificial Sequence
  Synthetic
gccaagcatttaggtgacactatagatctcacgaagctccaagtggtttcagagctatgctggaaacagc

SEQ ID NO: 58021 - DNA, 70 bp, Artificial Sequence
  Synthetic
gccaagcatttaggtgacactatagccatcggaaagctgtgtgaggtttcagagctatgctggaaacagc

SEQ ID NO: 58022 - DNA, 70 bp, Artificial Sequence
  Synthetic
gccaagcatttaggtgacactatagagctgtctgtagacgctcacgtttcagagctatgctggaaacagc

SEQ ID NO: 58023 - DNA, 70 bp, Artificial Sequence
  Synthetic
gccaagcatttaggtgacactataggacacccctggtggcctgctgtttcagagctatgctggaaacagc

SEQ ID NO: 58024 - DNA, 70 bp, Artificial Sequence
  Synthetic
gccaagcatttaggtgacactataggtggacacggggcctcaccggtttcagagctatgctggaaacagc

SEQ ID NO: 58025 - DNA, 70 bp, Artificial Sequence
  Synthetic
gccaagcatttaggtgacactatagtgaagctttaatttcaggtcgtttcagagctatgctggaaacagc

SEQ ID NO: 58026 - DNA, 70 bp, Artificial Sequence
  Synthetic
gccaagcatttaggtgacactatagatgttcaggaagacagaggagtttcagagctatgctggaaacagc

SEQ ID NO: 58027 - DNA, 70 bp, Artificial Sequence
  Synthetic
gccaagcatttaggtgacactatagctgtcaggcagtgagatttcgtttcagagctatgctggaaacagc

SEQ ID NO: 58028 - DNA, 70 bp, Artificial Sequence
  Synthetic
gccaagcatttaggtgacactatagccgtacctgtcgaaagggctgtttcagagctatgctggaaacagc

SEQ ID NO: 58029 - DNA, 70 bp, Artificial Sequence
  Synthetic
gccaagcatttaggtgacactatagcttctataacccagtcacgagtttcagagctatgctggaaacagc

SEQ ID NO: 58030 - DNA, 70 bp, Artificial Sequence
  Synthetic
gccaagcatttaggtgacactatagacctctttgaaagctgaactgtttcagagctatgctggaaacagc

SEQ ID NO: 58031 - DNA, 70 bp, Artificial Sequence
  Synthetic
gccaagcatttaggtgacactatagccttgctcatgttctaagtagtttcagagctatgctggaaacagc

SEQ ID NO: 58032 - DNA, 70 bp, Artificial Sequence
  Synthetic
gccaagcatttaggtgacactatagactgtgcacagtacttaggggtttcagagctatgctggaaacagc

SEQ ID NO: 58033 - DNA, 70 bp, Artificial Sequence
  Synthetic
gccaagcatttaggtgacactatagagcaagcaagagcattgttagtttcagagctatgctggaaacagc

SEQ ID NO: 58034 - DNA, 70 bp, Artificial Sequence
  Synthetic
gccaagcatttaggtgacactatagttgagcacggagctcaggtcgtttcagagctatgctggaaacagc

SEQ ID NO: 58035 - DNA, 70 bp, Artificial Sequence
  Synthetic
gccaagcatttaggtgacactatagtgcaagtggagccagagtgggtttcagagctatgctggaaacagc

SEQ ID NO: 58036 - DNA, 70 bp, Artificial Sequence
  Synthetic
gccaagcatttaggtgacactataggtcagccactgcagatcagcgtttcagagctatgctggaaacagc

SEQ ID NO: 58037 - DNA, 70 bp, Artificial Sequence
  Synthetic
gccaagcatttaggtgacactatagggagcccagctgatctgcaggtttcagagctatgctggaaacagc

SEQ ID NO: 58038 - DNA, 70 bp, Artificial Sequence
  Synthetic
gccaagcatttaggtgacactataggcgtgcagctgagtagcagagtttcagagctatgctggaaacagc

SEQ ID NO: 58039 - DNA, 70 bp, Artificial Sequence
  Synthetic
gccaagcatttaggtgacactatagcccagctcatccagggaggggtttcagagctatgctggaaacagc

SEQ ID NO: 58040 - DNA, 70 bp, Artificial Sequence
  Synthetic
gccaagcatttaggtgacactatagttcttaagaagcttgtttcggtttcagagctatgctggaaacagc

SEQ ID NO: 58041 - DNA, 70 bp, Artificial Sequence
  Synthetic
gccaagcatttaggtgacactatagcctctcagctttttcgtattgtttcagagctatgctggaaacagc

SEQ ID NO: 58042 - DNA, 70 bp, Artificial Sequence
  Synthetic
gccaagcatttaggtgacactatagacaaaggtcccagccatcaggtttcagagctatgctggaaacagc

SEQ ID NO: 58043 - DNA, 70 bp, Artificial Sequence
  Synthetic
gccaagcatttaggtgacactataggcctccccacaagcagaaaagtttcagagctatgctggaaacagc

SEQ ID NO: 58044 - DNA, 70 bp, Artificial Sequence
  Synthetic
gccaagcatttaggtgacactatagttgatggttctctcttgaatgtttcagagctatgctggaaacagc

SEQ ID NO: 58045 - DNA, 70 bp, Artificial Sequence
  Synthetic
gccaagcatttaggtgacactatagtttcggggagagatttaagcgtttcagagctatgctggaaacagc

SEQ ID NO: 58046 - DNA, 70 bp, Artificial Sequence
  Synthetic
gccaagcatttaggtgacactatagagtggctgagcaggacacacgtttcagagctatgctggaaacagc

SEQ ID NO: 58047 - DNA, 70 bp, Artificial Sequence
  Synthetic
gccaagcatttaggtgacactataggaatgcttgagaggactttagtttcagagctatgctggaaacagc

SEQ ID NO: 58048 - DNA, 70 bp, Artificial Sequence
  Synthetic
gccaagcatttaggtgacactatagttaaagccccaggattaagagtttcagagctatgctggaaacagc

SEQ ID NO: 58049 - DNA, 70 bp, Artificial Sequence
  Synthetic
gccaagcatttaggtgacactataggacagaagcaccctctgccagtttcagagctatgctggaaacagc

SEQ ID NO: 58050 - DNA, 70 bp, Artificial Sequence
  Synthetic
gccaagcatttaggtgacactatagttgcagaggtgcgcaaaacagtttcagagctatgctggaaacagc

SEQ ID NO: 58051 - DNA, 70 bp, Artificial Sequence
  Synthetic
gccaagcatttaggtgacactataggtgcctgctgtctgctgtaagtttcagagctatgctggaaacagc

SEQ ID NO: 58052 - DNA, 70 bp, Artificial Sequence
  Synthetic
gccaagcatttaggtgacactatagttgtattcagtgacagagccgtttcagagctatgctggaaacagc

SEQ ID NO: 58053 - DNA, 70 bp, Artificial Sequence
  Synthetic
gccaagcatttaggtgacactatagaagggcatggggatgggaaggtttcagagctatgctggaaacagc

SEQ ID NO: 58054 - DNA, 70 bp, Artificial Sequence
  Synthetic
gccaagcatttaggtgacactatagtagatggtggaggcatcagcgtttcagagctatgctggaaacagc

SEQ ID NO: 58055 - DNA, 70 bp, Artificial Sequence
  Synthetic
gccaagcatttaggtgacactatagtctatgcagttgtagtttgagtttcagagctatgctggaaacagc

SEQ ID NO: 58056 - DNA, 70 bp, Artificial Sequence
  Synthetic
gccaagcatttaggtgacactatagagctattggcagcagccttggtttcagagctatgctggaaacagc

SEQ ID NO: 58057 - DNA, 70 bp, Artificial Sequence
  Synthetic
gccaagcatttaggtgacactatagagcaatactcaaacattcacgtttcagagctatgctggaaacagc

SEQ ID NO: 58058 - DNA, 70 bp, Artificial Sequence
  Synthetic
gccaagcatttaggtgacactatagtgtgcggcgtcctcaagcaggtttcagagctatgctggaaacagc

SEQ ID NO: 58059 - DNA, 70 bp, Artificial Sequence
  Synthetic
gccaagcatttaggtgacactatagccccttacctggcctctagggtttcagagctatgctggaaacagc

SEQ ID NO: 58060 - DNA, 70 bp, Artificial Sequence
  Synthetic
gccaagcatttaggtgacactatagtctacaagcttagtaaacccgtttcagagctatgctggaaacagc

SEQ ID NO: 58061 - DNA, 70 bp, Artificial Sequence
  Synthetic
gccaagcatttaggtgacactatagccagtgggtgcctgtcagctgtttcagagctatgctggaaacagc

SEQ ID NO: 58062 - DNA, 70 bp, Artificial Sequence
  Synthetic
gccaagcatttaggtgacactataggggtacctgttagttgggtcgtttcagagctatgctggaaacagc

SEQ ID NO: 58063 - DNA, 70 bp, Artificial Sequence
  Synthetic
gccaagcatttaggtgacactatagtcattgagactcagtatctggtttcagagctatgctggaaacagc

SEQ ID NO: 58064 - DNA, 70 bp, Artificial Sequence
  Synthetic
gccaagcatttaggtgacactataggggtaccatccacttggctggtttcagagctatgctggaaacagc

SEQ ID NO: 58065 - DNA, 70 bp, Artificial Sequence
  Synthetic
gccaagcatttaggtgacactatagacagtgggtcccaatcagctgtttcagagctatgctggaaacagc

SEQ ID NO: 58066 - DNA, 70 bp, Artificial Sequence
  Synthetic
gccaagcatttaggtgacactatagcccattgggtgccagtgagcgtttcagagctatgctggaaacagc

SEQ ID NO: 58067 - DNA, 70 bp, Artificial Sequence
  Synthetic
gccaagcatttaggtgacactatagctttctggtttgaacttgctgtttcagagctatgctggaaacagc

SEQ ID NO: 58068 - DNA, 70 bp, Artificial Sequence
  Synthetic
gccaagcatttaggtgacactatagtggggagcagtcaggagttcgtttcagagctatgctggaaacagc

SEQ ID NO: 58069 - DNA, 70 bp, Artificial Sequence
  Synthetic
gccaagcatttaggtgacactatagtgagcatctccaaggcactggtttcagagctatgctggaaacagc

SEQ ID NO: 58070 - DNA, 70 bp, Artificial Sequence
  Synthetic
gccaagcatttaggtgacactatagttagagcttcaggaaccctggtttcagagctatgctggaaacagc

SEQ ID NO: 58071 - DNA, 70 bp, Artificial Sequence
  Synthetic
gccaagcatttaggtgacactatagcagggacttgaagaaagactgtttcagagctatgctggaaacagc

SEQ ID NO: 58072 - DNA, 70 bp, Artificial Sequence
  Synthetic
gccaagcatttaggtgacactatagcgtaattgagcaggtctcgtgtttcagagctatgctggaaacagc

SEQ ID NO: 58073 - DNA, 70 bp, Artificial Sequence
  Synthetic
gccaagcatttaggtgacactatagtgtgtcctgcccagcttcaggtttcagagctatgctggaaacagc

SEQ ID NO: 58074 - DNA, 70 bp, Artificial Sequence
  Synthetic
gccaagcatttaggtgacactatagacctgtcctggaaggcacatgtttcagagctatgctggaaacagc

SEQ ID NO: 58075 - DNA, 70 bp, Artificial Sequence
  Synthetic
gccaagcatttaggtgacactatagtccttgacttctcatttcttgtttcagagctatgctggaaacagc

SEQ ID NO: 58076 - DNA, 70 bp, Artificial Sequence
  Synthetic
gccaagcatttaggtgacactatagttttcccagcagagtggtgagtttcagagctatgctggaaacagc

SEQ ID NO: 58077 - DNA, 70 bp, Artificial Sequence
  Synthetic
gccaagcatttaggtgacactatagagcagacagttcagtctgctgtttcagagctatgctggaaacagc

SEQ ID NO: 58078 - DNA, 70 bp, Artificial Sequence
  Synthetic
gccaagcatttaggtgacactatagctcgcaaggataagaaataggtttcagagctatgctggaaacagc

SEQ ID NO: 58079 - DNA, 70 bp, Artificial Sequence
  Synthetic
gccaagcatttaggtgacactatagtctgtatgggagcactcaaagtttcagagctatgctggaaacagc

SEQ ID NO: 58080 - DNA, 70 bp, Artificial Sequence
  Synthetic
gccaagcatttaggtgacactataggtcagagtctgtggtgtatggtttcagagctatgctggaaacagc

SEQ ID NO: 58081 - DNA, 70 bp, Artificial Sequence
  Synthetic
gccaagcatttaggtgacactatagtctaactgtgcatatatgacgtttcagagctatgctggaaacagc

SEQ ID NO: 58082 - DNA, 70 bp, Artificial Sequence
  Synthetic
gccaagcatttaggtgacactatagaaggctcaaccaagagaaaagtttcagagctatgctggaaacagc

SEQ ID NO: 58083 - DNA, 70 bp, Artificial Sequence
  Synthetic
gccaagcatttaggtgacactatagtctcttcatagtctgaatccgtttcagagctatgctggaaacagc

SEQ ID NO: 58084 - DNA, 70 bp, Artificial Sequence
  Synthetic
gccaagcatttaggtgacactataggggatctgcaatcatcgatcgtttcagagctatgctggaaacagc

SEQ ID NO: 58085 - DNA, 70 bp, Artificial Sequence
  Synthetic
gccaagcatttaggtgacactatagacatcagctctgcaattgaggtttcagagctatgctggaaacagc

SEQ ID NO: 58086 - DNA, 70 bp, Artificial Sequence
  Synthetic
gccaagcatttaggtgacactataggaggaaggggcggcctgacggtttcagagctatgctggaaacagc

SEQ ID NO: 58087 - DNA, 70 bp, Artificial Sequence
  Synthetic
gccaagcatttaggtgacactatagcagagcatgtttctcaatccgtttcagagctatgctggaaacagc

SEQ ID NO: 58088 - DNA, 70 bp, Artificial Sequence
  Synthetic
gccaagcatttaggtgacactataggcaatgtgtgatcttgtgacgtttcagagctatgctggaaacagc

SEQ ID NO: 58089 - DNA, 70 bp, Artificial Sequence
  Synthetic
gccaagcatttaggtgacactatagagtgatatgaaagatctcgtgtttcagagctatgctggaaacagc

SEQ ID NO: 58090 - DNA, 70 bp, Artificial Sequence
  Synthetic
gccaagcatttaggtgacactataggaacatcctggtgtcagacagtttcagagctatgctggaaacagc

SEQ ID NO: 58091 - DNA, 70 bp, Artificial Sequence
  Synthetic
gccaagcatttaggtgacactatagccagagtcaagtatcgaaaggtttcagagctatgctggaaacagc

SEQ ID NO: 58092 - DNA, 70 bp, Artificial Sequence
  Synthetic
gccaagcatttaggtgacactatagttccgtttccaagtccctaagtttcagagctatgctggaaacagc

SEQ ID NO: 58093 - DNA, 70 bp, Artificial Sequence
  Synthetic
gccaagcatttaggtgacactatagccaaacacagggtaaaacaggtttcagagctatgctggaaacagc

SEQ ID NO: 58094 - DNA, 70 bp, Artificial Sequence
  Synthetic
gccaagcatttaggtgacactatagactcgctcttctctatccgcgtttcagagctatgctggaaacagc

SEQ ID NO: 58095 - DNA, 70 bp, Artificial Sequence
  Synthetic
gccaagcatttaggtgacactatagagagaagcgagtcttcttgagtttcagagctatgctggaaacagc

SEQ ID NO: 58096 - DNA, 70 bp, Artificial Sequence
  Synthetic
gccaagcatttaggtgacactatagcagggctgagggtctacgtggtttcagagctatgctggaaacagc

SEQ ID NO: 58097 - DNA, 70 bp, Artificial Sequence
  Synthetic
gccaagcatttaggtgacactatagcgtgggcaccaatgagatgggtttcagagctatgctggaaacagc

SEQ ID NO: 58098 - DNA, 70 bp, Artificial Sequence
  Synthetic
gccaagcatttaggtgacactatagctcaggctgctatgtccaccgtttcagagctatgctggaaacagc

SEQ ID NO: 58099 - DNA, 70 bp, Artificial Sequence
  Synthetic
gccaagcatttaggtgacactatagccaggcgctggagtctcagggtttcagagctatgctggaaacagc

SEQ ID NO: 58100 - DNA, 70 bp, Artificial Sequence
  Synthetic
gccaagcatttaggtgacactatagaggggacagtccctgcccatgtttcagagctatgctggaaacagc

SEQ ID NO: 58101 - DNA, 70 bp, Artificial Sequence
  Synthetic
gccaagcatttaggtgacactatagggagatgtcgagaagcagtcgtttcagagctatgctggaaacagc

SEQ ID NO: 58102 - DNA, 70 bp, Artificial Sequence
  Synthetic
gccaagcatttaggtgacactatagggaagcagattggagcagtggtttcagagctatgctggaaacagc

SEQ ID NO: 58103 - DNA, 70 bp, Artificial Sequence
  Synthetic
gccaagcatttaggtgacactataggaagcagattggggccatgagtttcagagctatgctggaaacagc

SEQ ID NO: 58104 - DNA, 70 bp, Artificial Sequence
  Synthetic
gccaagcatttaggtgacactatagagagctgagttggttacatcgtttcagagctatgctggaaacagc

SEQ ID NO: 58105 - DNA, 70 bp, Artificial Sequence
  Synthetic
gccaagcatttaggtgacactatagtcctgtaatcccagctactcgtttcagagctatgctggaaacagc

SEQ ID NO: 58106 - DNA, 70 bp, Artificial Sequence
  Synthetic
gccaagcatttaggtgacactatagtggatatgactggtaaaaacgtttcagagctatgctggaaacagc

SEQ ID NO: 58107 - DNA, 70 bp, Artificial Sequence
  Synthetic
gccaagcatttaggtgacactatagaggcaaaatgagggctgacggtttcagagctatgctggaaacagc

SEQ ID NO: 58108 - DNA, 70 bp, Artificial Sequence
  Synthetic
gccaagcatttaggtgacactatagaagggcactgtgaagcagtggtttcagagctatgctggaaacagc

SEQ ID NO: 58109 - DNA, 70 bp, Artificial Sequence
  Synthetic
gccaagcatttaggtgacactatagagtcacttctgcgtcctcaggtttcagagctatgctggaaacagc

SEQ ID NO: 58110 - DNA, 70 bp, Artificial Sequence
  Synthetic
gccaagcatttaggtgacactatagttcgatgatgatgtgtgatcgtttcagagctatgctggaaacagc

SEQ ID NO: 58111 - DNA, 70 bp, Artificial Sequence
  Synthetic
gccaagcatttaggtgacactatagtatttgcgtagaagaactgcgtttcagagctatgctggaaacagc

SEQ ID NO: 58112 - DNA, 70 bp, Artificial Sequence
  Synthetic
gccaagcatttaggtgacactatagcgcctggtgaagctcgcctagtttcagagctatgctggaaacagc

SEQ ID NO: 58113 - DNA, 70 bp, Artificial Sequence
  Synthetic
gccaagcatttaggtgacactatagggtgactcaagcaacagacggtttcagagctatgctggaaacagc

SEQ ID NO: 58114 - DNA, 70 bp, Artificial Sequence
  Synthetic
gccaagcatttaggtgacactatagaccccaaggaatgtcctagggtttcagagctatgctggaaacagc

SEQ ID NO: 58115 - DNA, 70 bp, Artificial Sequence
  Synthetic
gccaagcatttaggtgacactatagtatttcttgatggcttacaggtttcagagctatgctggaaacagc

SEQ ID NO: 58116 - DNA, 70 bp, Artificial Sequence
  Synthetic
gccaagcatttaggtgacactataggatggctggaggtcactgctgtttcagagctatgctggaaacagc

SEQ ID NO: 58117 - DNA, 70 bp, Artificial Sequence
  Synthetic
gccaagcatttaggtgacactatagtccggaccccgccgagcctggtttcagagctatgctggaaacagc

SEQ ID NO: 58118 - DNA, 70 bp, Artificial Sequence
  Synthetic
gccaagcatttaggtgacactatagtcagggacgtcacttcttcagtttcagagctatgctggaaacagc

SEQ ID NO: 58119 - DNA, 70 bp, Artificial Sequence
  Synthetic
gccaagcatttaggtgacactatagattagaggggcaaagctcaagtttcagagctatgctggaaacagc

SEQ ID NO: 58120 - DNA, 70 bp, Artificial Sequence
  Synthetic
gccaagcatttaggtgacactatagtgccttgtgtttctaggcaggtttcagagctatgctggaaacagc

SEQ ID NO: 58121 - DNA, 70 bp, Artificial Sequence
  Synthetic
gccaagcatttaggtgacactataggtatctctccctctgaatgtgtttcagagctatgctggaaacagc

SEQ ID NO: 58122 - DNA, 70 bp, Artificial Sequence
  Synthetic
gccaagcatttaggtgacactatagttgacatctttactgtctgtgtttcagagctatgctggaaacagc

SEQ ID NO: 58123 - DNA, 70 bp, Artificial Sequence
  Synthetic
gccaagcatttaggtgacactatagcttcgtagttcaacaagtgagtttcagagctatgctggaaacagc

SEQ ID NO: 58124 - DNA, 70 bp, Artificial Sequence
  Synthetic
gccaagcatttaggtgacactatagaaacaggctggctacgagtcgtttcagagctatgctggaaacagc

SEQ ID NO: 58125 - DNA, 70 bp, Artificial Sequence
  Synthetic
gccaagcatttaggtgacactataggtggggcaagggtcacttctgtttcagagctatgctggaaacagc

SEQ ID NO: 58126 - DNA, 70 bp, Artificial Sequence
  Synthetic
gccaagcatttaggtgacactataggggagaagttcagtgtgaccgtttcagagctatgctggaaacagc

SEQ ID NO: 58127 - DNA, 70 bp, Artificial Sequence
  Synthetic
gccaagcatttaggtgacactatagggtgggcggcaccgtggttcgtttcagagctatgctggaaacagc

SEQ ID NO: 58128 - DNA, 70 bp, Artificial Sequence
  Synthetic
gccaagcatttaggtgacactatagtcttatagccgataatcttcgtttcagagctatgctggaaacagc

SEQ ID NO: 58129 - DNA, 70 bp, Artificial Sequence
  Synthetic
gccaagcatttaggtgacactatagtcacacaaagttctgagcaagtttcagagctatgctggaaacagc

SEQ ID NO: 58130 - DNA, 70 bp, Artificial Sequence
  Synthetic
gccaagcatttaggtgacactatagtccttggacgggaattcatggtttcagagctatgctggaaacagc

SEQ ID NO: 58131 - DNA, 70 bp, Artificial Sequence
  Synthetic
gccaagcatttaggtgacactatagctacactcactacacacgttgtttcagagctatgctggaaacagc

SEQ ID NO: 58132 - DNA, 70 bp, Artificial Sequence
  Synthetic
gccaagcatttaggtgacactatagtcaaacaccagggatttaacgtttcagagctatgctggaaacagc

SEQ ID NO: 58133 - DNA, 70 bp, Artificial Sequence
  Synthetic
gccaagcatttaggtgacactatagagaaggtggtgtggttctacgtttcagagctatgctggaaacagc

SEQ ID NO: 58134 - DNA, 70 bp, Artificial Sequence
  Synthetic
gccaagcatttaggtgacactatagaggaaattgaagcgtcgaaagtttcagagctatgctggaaacagc

SEQ ID NO: 58135 - DNA, 70 bp, Artificial Sequence
  Synthetic
gccaagcatttaggtgacactataggagtacagggatatcagcttgtttcagagctatgctggaaacagc

SEQ ID NO: 58136 - DNA, 70 bp, Artificial Sequence
  Synthetic
gccaagcatttaggtgacactatagccgtttgttatgatcaacgtgtttcagagctatgctggaaacagc

SEQ ID NO: 58137 - DNA, 70 bp, Artificial Sequence
  Synthetic
gccaagcatttaggtgacactatagaatacagcaacagtcctcaggtttcagagctatgctggaaacagc

SEQ ID NO: 58138 - DNA, 70 bp, Artificial Sequence
  Synthetic
gccaagcatttaggtgacactatagttggcttaaagggttaccctgtttcagagctatgctggaaacagc

SEQ ID NO: 58139 - DNA, 70 bp, Artificial Sequence
  Synthetic
gccaagcatttaggtgacactatagctcggtaatcacaacaaacagtttcagagctatgctggaaacagc

SEQ ID NO: 58140 - DNA, 70 bp, Artificial Sequence
  Synthetic
gccaagcatttaggtgacactatagatcgttcacactctatgatggtttcagagctatgctggaaacagc

SEQ ID NO: 58141 - DNA, 70 bp, Artificial Sequence
  Synthetic
gccaagcatttaggtgacactatagagctggttcgggctgtgacggtttcagagctatgctggaaacagc

SEQ ID NO: 58142 - DNA, 70 bp, Artificial Sequence
  Synthetic
gccaagcatttaggtgacactatagggagacccggaaatacaagagtttcagagctatgctggaaacagc

SEQ ID NO: 58143 - DNA, 70 bp, Artificial Sequence
  Synthetic
gccaagcatttaggtgacactataggcctgagggcaccttcaaacgtttcagagctatgctggaaacagc

SEQ ID NO: 58144 - DNA, 70 bp, Artificial Sequence
  Synthetic
gccaagcatttaggtgacactatagtggaggagctgtgtggtcacgtttcagagctatgctggaaacagc

SEQ ID NO: 58145 - DNA, 70 bp, Artificial Sequence
  Synthetic
gccaagcatttaggtgacactatagaaatgtaatagaaggcgcacgtttcagagctatgctggaaacagc

SEQ ID NO: 58146 - DNA, 70 bp, Artificial Sequence
  Synthetic
gccaagcatttaggtgacactatagtcatgtgctttctgctccacgtttcagagctatgctggaaacagc

SEQ ID NO: 58147 - DNA, 70 bp, Artificial Sequence
  Synthetic
gccaagcatttaggtgacactatagaacatctttggtgtcaattcgtttcagagctatgctggaaacagc

SEQ ID NO: 58148 - DNA, 70 bp, Artificial Sequence
  Synthetic
gccaagcatttaggtgacactataggaaacaaagagtcctcttcggtttcagagctatgctggaaacagc

SEQ ID NO: 58149 - DNA, 70 bp, Artificial Sequence
  Synthetic
gccaagcatttaggtgacactatagtaaagagaagactgagggcggtttcagagctatgctggaaacagc

SEQ ID NO: 58150 - DNA, 70 bp, Artificial Sequence
  Synthetic
gccaagcatttaggtgacactataggactgcgtcgcgatcctcaagtttcagagctatgctggaaacagc

SEQ ID NO: 58151 - DNA, 70 bp, Artificial Sequence
  Synthetic
gccaagcatttaggtgacactatagccttctggaagaggcgaaacgtttcagagctatgctggaaacagc

SEQ ID NO: 58152 - DNA, 70 bp, Artificial Sequence
  Synthetic
gccaagcatttaggtgacactatagtgacgacgtccttctggaaggtttcagagctatgctggaaacagc

SEQ ID NO: 58153 - DNA, 70 bp, Artificial Sequence
  Synthetic
gccaagcatttaggtgacactatagatctgtctctgcttgtgcctgtttcagagctatgctggaaacagc

SEQ ID NO: 58154 - DNA, 70 bp, Artificial Sequence
  Synthetic
gccaagcatttaggtgacactatagcaaaatgcaaggtgacttctgtttcagagctatgctggaaacagc

SEQ ID NO: 58155 - DNA, 70 bp, Artificial Sequence
  Synthetic
gccaagcatttaggtgacactatagtttgcatggtgctgcgtgaggtttcagagctatgctggaaacagc

SEQ ID NO: 58156 - DNA, 70 bp, Artificial Sequence
  Synthetic
gccaagcatttaggtgacactatagcccacctatggcatctactagtttcagagctatgctggaaacagc

SEQ ID NO: 58157 - DNA, 70 bp, Artificial Sequence
  Synthetic
gccaagcatttaggtgacactatagactctgagactgttccatgggtttcagagctatgctggaaacagc

SEQ ID NO: 58158 - DNA, 70 bp, Artificial Sequence
  Synthetic
gccaagcatttaggtgacactatagagatcaaagtaaagcaacaggtttcagagctatgctggaaacagc

SEQ ID NO: 58159 - DNA, 70 bp, Artificial Sequence
  Synthetic
gccaagcatttaggtgacactatagaaccgctgtgattctaacaggtttcagagctatgctggaaacagc

SEQ ID NO: 58160 - DNA, 70 bp, Artificial Sequence
  Synthetic
gccaagcatttaggtgacactataggaggtgcttcacatcaacaggtttcagagctatgctggaaacagc

SEQ ID NO: 58161 - DNA, 70 bp, Artificial Sequence
  Synthetic
gccaagcatttaggtgacactatagcaccaaggtgtacacacaaggtttcagagctatgctggaaacagc

SEQ ID NO: 58162 - DNA, 70 bp, Artificial Sequence
  Synthetic
gccaagcatttaggtgacactatagaggaacttcctgcgctagctgtttcagagctatgctggaaacagc

SEQ ID NO: 58163 - DNA, 70 bp, Artificial Sequence
  Synthetic
gccaagcatttaggtgacactatagcctccaaaagacagatgatggtttcagagctatgctggaaacagc

SEQ ID NO: 58164 - DNA, 70 bp, Artificial Sequence
  Synthetic
gccaagcatttaggtgacactatagtggagcttatagccaagtaggtttcagagctatgctggaaacagc

SEQ ID NO: 58165 - DNA, 70 bp, Artificial Sequence
  Synthetic
gccaagcatttaggtgacactatagtggatgacaagggttcaggagtttcagagctatgctggaaacagc

SEQ ID NO: 58166 - DNA, 70 bp, Artificial Sequence
  Synthetic
gccaagcatttaggtgacactatagaggtcactgcccccagaagcgtttcagagctatgctggaaacagc

SEQ ID NO: 58167 - DNA, 70 bp, Artificial Sequence
  Synthetic
gccaagcatttaggtgacactatagccactgtgtgctcagcgtgagtttcagagctatgctggaaacagc

SEQ ID NO: 58168 - DNA, 70 bp, Artificial Sequence
  Synthetic
gccaagcatttaggtgacactatagctcttcactgtgcttgcaccgtttcagagctatgctggaaacagc

SEQ ID NO: 58169 - DNA, 70 bp, Artificial Sequence
  Synthetic
gccaagcatttaggtgacactatagctgcatccatggcggctagcgtttcagagctatgctggaaacagc

SEQ ID NO: 58170 - DNA, 70 bp, Artificial Sequence
  Synthetic
gccaagcatttaggtgacactatagttttgtcatcaggctagctggtttcagagctatgctggaaacagc

SEQ ID NO: 58171 - DNA, 70 bp, Artificial Sequence
  Synthetic
gccaagcatttaggtgacactatagcaggcagctcggcccatcaggtttcagagctatgctggaaacagc

SEQ ID NO: 58172 - DNA, 70 bp, Artificial Sequence
  Synthetic
gccaagcatttaggtgacactatagttttgggcttcagcaagatggtttcagagctatgctggaaacagc

SEQ ID NO: 58173 - DNA, 70 bp, Artificial Sequence
  Synthetic
gccaagcatttaggtgacactatagctacagtagctacttcaactgtttcagagctatgctggaaacagc

SEQ ID NO: 58174 - DNA, 70 bp, Artificial Sequence
  Synthetic
gccaagcatttaggtgacactatagctcttggagaaaggcttctggtttcagagctatgctggaaacagc

SEQ ID NO: 58175 - DNA, 70 bp, Artificial Sequence
  Synthetic
gccaagcatttaggtgacactatagcccccaatttgaaaatcactgtttcagagctatgctggaaacagc

SEQ ID NO: 58176 - DNA, 70 bp, Artificial Sequence
  Synthetic
gccaagcatttaggtgacactatagtctatcgaaacttcccatgtgtttcagagctatgctggaaacagc

SEQ ID NO: 58177 - DNA, 70 bp, Artificial Sequence
  Synthetic
gccaagcatttaggtgacactataggcaggaagaacaaaggaagcgtttcagagctatgctggaaacagc

SEQ ID NO: 58178 - DNA, 70 bp, Artificial Sequence
  Synthetic
gccaagcatttaggtgacactataggctcttcagtgaagccccttgtttcagagctatgctggaaacagc

SEQ ID NO: 58179 - DNA, 70 bp, Artificial Sequence
  Synthetic
gccaagcatttaggtgacactataggacaagccgggcgctgatacgtttcagagctatgctggaaacagc

SEQ ID NO: 58180 - DNA, 70 bp, Artificial Sequence
  Synthetic
gccaagcatttaggtgacactatagaagaacaagaggttgtagcagtttcagagctatgctggaaacagc

SEQ ID NO: 58181 - DNA, 70 bp, Artificial Sequence
  Synthetic
gccaagcatttaggtgacactatagctggagccacggtcacttctgtttcagagctatgctggaaacagc

SEQ ID NO: 58182 - DNA, 70 bp, Artificial Sequence
  Synthetic
gccaagcatttaggtgacactatagtggtccgcaatgaatctatggtttcagagctatgctggaaacagc

SEQ ID NO: 58183 - DNA, 70 bp, Artificial Sequence
  Synthetic
gccaagcatttaggtgacactataggacaagcaggagggtcgacagtttcagagctatgctggaaacagc

SEQ ID NO: 58184 - DNA, 70 bp, Artificial Sequence
  Synthetic
gccaagcatttaggtgacactataggagaggactttcacaccatagtttcagagctatgctggaaacagc

SEQ ID NO: 58185 - DNA, 70 bp, Artificial Sequence
  Synthetic
gccaagcatttaggtgacactatagagggagagtagatttagatcgtttcagagctatgctggaaacagc

SEQ ID NO: 58186 - DNA, 70 bp, Artificial Sequence
  Synthetic
gccaagcatttaggtgacactatagtctgatagtgtttcccagatgtttcagagctatgctggaaacagc

SEQ ID NO: 58187 - DNA, 70 bp, Artificial Sequence
  Synthetic
gccaagcatttaggtgacactatagatgaaaatcccttctcataggtttcagagctatgctggaaacagc

SEQ ID NO: 58188 - DNA, 70 bp, Artificial Sequence
  Synthetic
gccaagcatttaggtgacactatagctcccagccacaccaagttcgtttcagagctatgctggaaacagc

SEQ ID NO: 58189 - DNA, 70 bp, Artificial Sequence
  Synthetic
gccaagcatttaggtgacactataggaaggctcggaagctgtgatgtttcagagctatgctggaaacagc

SEQ ID NO: 58190 - DNA, 70 bp, Artificial Sequence
  Synthetic
gccaagcatttaggtgacactataggccacgtgcagaagaagtgagtttcagagctatgctggaaacagc

SEQ ID NO: 58191 - DNA, 70 bp, Artificial Sequence
  Synthetic
gccaagcatttaggtgacactatagctgggatccagcgagcgacagtttcagagctatgctggaaacagc

SEQ ID NO: 58192 - DNA, 70 bp, Artificial Sequence
  Synthetic
gccaagcatttaggtgacactatagtggctgtctttgagtgtcttgtttcagagctatgctggaaacagc

SEQ ID NO: 58193 - DNA, 70 bp, Artificial Sequence
  Synthetic
gccaagcatttaggtgacactatagtgcagaagctacagatacaggtttcagagctatgctggaaacagc

SEQ ID NO: 58194 - DNA, 70 bp, Artificial Sequence
  Synthetic
gccaagcatttaggtgacactatagatctcttcagcacagtgaaggtttcagagctatgctggaaacagc

SEQ ID NO: 58195 - DNA, 70 bp, Artificial Sequence
  Synthetic
gccaagcatttaggtgacactataggtgaagatggcccaccgagcgtttcagagctatgctggaaacagc

SEQ ID NO: 58196 - DNA, 70 bp, Artificial Sequence
  Synthetic
gccaagcatttaggtgacactatagtgtcagtgatacagcttccagtttcagagctatgctggaaacagc

SEQ ID NO: 58197 - DNA, 70 bp, Artificial Sequence
  Synthetic
gccaagcatttaggtgacactatagaggccctcagagtgctctgtgtttcagagctatgctggaaacagc

SEQ ID NO: 58198 - DNA, 70 bp, Artificial Sequence
  Synthetic
gccaagcatttaggtgacactatagacaacaggtatccagcaatggtttcagagctatgctggaaacagc

SEQ ID NO: 58199 - DNA, 70 bp, Artificial Sequence
  Synthetic
gccaagcatttaggtgacactatagcaaggatcctgcatatctcagtttcagagctatgctggaaacagc

SEQ ID NO: 58200 - DNA, 70 bp, Artificial Sequence
  Synthetic
gccaagcatttaggtgacactatagtgtttcttcccacaaagaccgtttcagagctatgctggaaacagc

SEQ ID NO: 58201 - DNA, 70 bp, Artificial Sequence
  Synthetic
gccaagcatttaggtgacactataggggaggagagtgaacatcacgtttcagagctatgctggaaacagc

SEQ ID NO: 58202 - DNA, 70 bp, Artificial Sequence
  Synthetic
gccaagcatttaggtgacactataggatccgtggcagggctgctggtttcagagctatgctggaaacagc

SEQ ID NO: 58203 - DNA, 70 bp, Artificial Sequence
  Synthetic
gccaagcatttaggtgacactatagatttttaggaagctgcagaagtttcagagctatgctggaaacagc

SEQ ID NO: 58204 - DNA, 70 bp, Artificial Sequence
  Synthetic
gccaagcatttaggtgacactatagaaggtctcttgcctccctgagtttcagagctatgctggaaacagc

SEQ ID NO: 58205 - DNA, 70 bp, Artificial Sequence
  Synthetic
gccaagcatttaggtgacactatagaaagccgatgcccaggactagtttcagagctatgctggaaacagc

SEQ ID NO: 58206 - DNA, 70 bp, Artificial Sequence
  Synthetic
gccaagcatttaggtgacactatagcacaacgcagggactcctaggtttcagagctatgctggaaacagc

SEQ ID NO: 58207 - DNA, 70 bp, Artificial Sequence
  Synthetic
gccaagcatttaggtgacactataggcaaaggcatctgcctaatagtttcagagctatgctggaaacagc

SEQ ID NO: 58208 - DNA, 70 bp, Artificial Sequence
  Synthetic
gccaagcatttaggtgacactatagatcttgagtctttactctccgtttcagagctatgctggaaacagc

SEQ ID NO: 58209 - DNA, 70 bp, Artificial Sequence
  Synthetic
gccaagcatttaggtgacactatagagaagaaaaatcacagctgtgtttcagagctatgctggaaacagc

SEQ ID NO: 58210 - DNA, 70 bp, Artificial Sequence
  Synthetic
gccaagcatttaggtgacactatagagaaggttgaacacatagaggtttcagagctatgctggaaacagc

SEQ ID NO: 58211 - DNA, 70 bp, Artificial Sequence
  Synthetic
gccaagcatttaggtgacactatagaagggaaaagagcagcaaaagtttcagagctatgctggaaacagc

SEQ ID NO: 58212 - DNA, 70 bp, Artificial Sequence
  Synthetic
gccaagcatttaggtgacactataggctggttctggcattctagagtttcagagctatgctggaaacagc

SEQ ID NO: 58213 - DNA, 70 bp, Artificial Sequence
  Synthetic
gccaagcatttaggtgacactatagtcgtaattctgcctccttaagtttcagagctatgctggaaacagc

SEQ ID NO: 58214 - DNA, 70 bp, Artificial Sequence
  Synthetic
gccaagcatttaggtgacactatagttttctcagcagctttcatcgtttcagagctatgctggaaacagc

SEQ ID NO: 58215 - DNA, 70 bp, Artificial Sequence
  Synthetic
gccaagcatttaggtgacactatagagcagccaccatggttattcgtttcagagctatgctggaaacagc

SEQ ID NO: 58216 - DNA, 70 bp, Artificial Sequence
  Synthetic
gccaagcatttaggtgacactatagacaaggccagagaggttacggtttcagagctatgctggaaacagc

SEQ ID NO: 58217 - DNA, 70 bp, Artificial Sequence
  Synthetic
gccaagcatttaggtgacactatagtcacttcttcctcttctttggtttcagagctatgctggaaacagc

SEQ ID NO: 58218 - DNA, 70 bp, Artificial Sequence
  Synthetic
gccaagcatttaggtgacactatagcctggagactctaccaccaggtttcagagctatgctggaaacagc

SEQ ID NO: 58219 - DNA, 70 bp, Artificial Sequence
  Synthetic
gccaagcatttaggtgacactatagttacgtggaagaaacgctaagtttcagagctatgctggaaacagc

SEQ ID NO: 58220 - DNA, 70 bp, Artificial Sequence
  Synthetic
gccaagcatttaggtgacactatagcagtctcagaggacaccattgtttcagagctatgctggaaacagc

SEQ ID NO: 58221 - DNA, 70 bp, Artificial Sequence
  Synthetic
gccaagcatttaggtgacactatagccccagtggactttcatccagtttcagagctatgctggaaacagc

SEQ ID NO: 58222 - DNA, 70 bp, Artificial Sequence
  Synthetic
gccaagcatttaggtgacactatagggcagaactggacaggcatcgtttcagagctatgctggaaacagc

SEQ ID NO: 58223 - DNA, 70 bp, Artificial Sequence
  Synthetic
gccaagcatttaggtgacactatagatccacggggctgttcctaagtttcagagctatgctggaaacagc

SEQ ID NO: 58224 - DNA, 70 bp, Artificial Sequence
  Synthetic
gccaagcatttaggtgacactatagcattgcctcctatggtatgagtttcagagctatgctggaaacagc

SEQ ID NO: 58225 - DNA, 70 bp, Artificial Sequence
  Synthetic
gccaagcatttaggtgacactatagtcagaagatgatgactgaaagtttcagagctatgctggaaacagc

SEQ ID NO: 58226 - DNA, 70 bp, Artificial Sequence
  Synthetic
gccaagcatttaggtgacactatagtgagcagcctacagagcagtgtttcagagctatgctggaaacagc

SEQ ID NO: 58227 - DNA, 70 bp, Artificial Sequence
  Synthetic
gccaagcatttaggtgacactatagggagagctgtcattttctatgtttcagagctatgctggaaacagc

SEQ ID NO: 58228 - DNA, 70 bp, Artificial Sequence
  Synthetic
gccaagcatttaggtgacactatagtggctcttcagtttgcagtcgtttcagagctatgctggaaacagc

SEQ ID NO: 58229 - DNA, 70 bp, Artificial Sequence
  Synthetic
gccaagcatttaggtgacactatagagctgagtagttgttgcatcgtttcagagctatgctggaaacagc

SEQ ID NO: 58230 - DNA, 70 bp, Artificial Sequence
  Synthetic
gccaagcatttaggtgacactatagtgatcttacatctgttactggtttcagagctatgctggaaacagc

SEQ ID NO: 58231 - DNA, 70 bp, Artificial Sequence
  Synthetic
gccaagcatttaggtgacactatagcagccctgagttatccagtcgtttcagagctatgctggaaacagc

SEQ ID NO: 58232 - DNA, 70 bp, Artificial Sequence
  Synthetic
gccaagcatttaggtgacactatagctgctactcagacgactcctgtttcagagctatgctggaaacagc

SEQ ID NO: 58233 - DNA, 70 bp, Artificial Sequence
  Synthetic
gccaagcatttaggtgacactataggacaagccatctcatctaccgtttcagagctatgctggaaacagc

SEQ ID NO: 58234 - DNA, 70 bp, Artificial Sequence
  Synthetic
gccaagcatttaggtgacactatagtgtgcaaatcagctatttctgtttcagagctatgctggaaacagc

SEQ ID NO: 58235 - DNA, 70 bp, Artificial Sequence
  Synthetic
gccaagcatttaggtgacactatagatgggaggagacatttccccgtttcagagctatgctggaaacagc

SEQ ID NO: 58236 - DNA, 70 bp, Artificial Sequence
  Synthetic
gccaagcatttaggtgacactatagcttgattacacagaattggggtttcagagctatgctggaaacagc

SEQ ID NO: 58237 - DNA, 70 bp, Artificial Sequence
  Synthetic
gccaagcatttaggtgacactatagacaccacttaatgaggtttggtttcagagctatgctggaaacagc

SEQ ID NO: 58238 - DNA, 70 bp, Artificial Sequence
  Synthetic
gccaagcatttaggtgacactatagtcagaagatgggcggccggggtttcagagctatgctggaaacagc

SEQ ID NO: 58239 - DNA, 70 bp, Artificial Sequence
  Synthetic
gccaagcatttaggtgacactatagcacaatcacaatcctctgaggtttcagagctatgctggaaacagc

SEQ ID NO: 58240 - DNA, 70 bp, Artificial Sequence
  Synthetic
gccaagcatttaggtgacactatagtaggcaaggttaagtgaagcgtttcagagctatgctggaaacagc

SEQ ID NO: 58241 - DNA, 70 bp, Artificial Sequence
  Synthetic
gccaagcatttaggtgacactatagtcaaaaatgactcatgactggtttcagagctatgctggaaacagc

SEQ ID NO: 58242 - DNA, 70 bp, Artificial Sequence
  Synthetic
gccaagcatttaggtgacactatagtgctgtgctgcggtggaaacgtttcagagctatgctggaaacagc

SEQ ID NO: 58243 - DNA, 70 bp, Artificial Sequence
  Synthetic
gccaagcatttaggtgacactatagtgctcactgctgtgctgcaggtttcagagctatgctggaaacagc

SEQ ID NO: 58244 - DNA, 70 bp, Artificial Sequence
  Synthetic
gccaagcatttaggtgacactatagaaaagagttcttcacggtctgtttcagagctatgctggaaacagc

SEQ ID NO: 58245 - DNA, 70 bp, Artificial Sequence
  Synthetic
gccaagcatttaggtgacactatagtgtagccttacttatttgctgtttcagagctatgctggaaacagc

SEQ ID NO: 58246 - DNA, 70 bp, Artificial Sequence
  Synthetic
gccaagcatttaggtgacactatagcatcaccaagtccagcgtctgtttcagagctatgctggaaacagc

SEQ ID NO: 58247 - DNA, 70 bp, Artificial Sequence
  Synthetic
gccaagcatttaggtgacactataggagtgcctggaaaaagccatgtttcagagctatgctggaaacagc

SEQ ID NO: 58248 - DNA, 70 bp, Artificial Sequence
  Synthetic
gccaagcatttaggtgacactatagcatcctttctgggacttggtgtttcagagctatgctggaaacagc

SEQ ID NO: 58249 - DNA, 70 bp, Artificial Sequence
  Synthetic
gccaagcatttaggtgacactatagcccaaagtcttagggcgaatgtttcagagctatgctggaaacagc

SEQ ID NO: 58250 - DNA, 70 bp, Artificial Sequence
  Synthetic
gccaagcatttaggtgacactatagagacttcgaattcagaaagagtttcagagctatgctggaaacagc

SEQ ID NO: 58251 - DNA, 70 bp, Artificial Sequence
  Synthetic
gccaagcatttaggtgacactatagtgtggaaccaccgcttaaatgtttcagagctatgctggaaacagc

SEQ ID NO: 58252 - DNA, 70 bp, Artificial Sequence
  Synthetic
gccaagcatttaggtgacactataggggctctgggctctctgccggtttcagagctatgctggaaacagc

SEQ ID NO: 58253 - DNA, 70 bp, Artificial Sequence
  Synthetic
gccaagcatttaggtgacactatagaaagggcatttgtttcacctgtttcagagctatgctggaaacagc

SEQ ID NO: 58254 - DNA, 70 bp, Artificial Sequence
  Synthetic
gccaagcatttaggtgacactataggtggacagaggagttcaacagtttcagagctatgctggaaacagc

SEQ ID NO: 58255 - DNA, 70 bp, Artificial Sequence
  Synthetic
gccaagcatttaggtgacactatagttctggaacttgttcagtccgtttcagagctatgctggaaacagc

SEQ ID NO: 58256 - DNA, 70 bp, Artificial Sequence
  Synthetic
gccaagcatttaggtgacactataggacactggaaggactctcaggtttcagagctatgctggaaacagc

SEQ ID NO: 58257 - DNA, 70 bp, Artificial Sequence
  Synthetic
gccaagcatttaggtgacactatagaagtttgcctggctagtgaagtttcagagctatgctggaaacagc

SEQ ID NO: 58258 - DNA, 70 bp, Artificial Sequence
  Synthetic
gccaagcatttaggtgacactataggccaccgtcccctgcttcaggtttcagagctatgctggaaacagc

SEQ ID NO: 58259 - DNA, 70 bp, Artificial Sequence
  Synthetic
gccaagcatttaggtgacactataggggaactgatagccatagctgtttcagagctatgctggaaacagc

SEQ ID NO: 58260 - DNA, 70 bp, Artificial Sequence
  Synthetic
gccaagcatttaggtgacactatagacaaatggataccattgagcgtttcagagctatgctggaaacagc

SEQ ID NO: 58261 - DNA, 70 bp, Artificial Sequence
  Synthetic
gccaagcatttaggtgacactatagaaacacctcaccggacgtgtgtttcagagctatgctggaaacagc

SEQ ID NO: 58262 - DNA, 70 bp, Artificial Sequence
  Synthetic
gccaagcatttaggtgacactataggcagctaaaaacgtcgttacgtttcagagctatgctggaaacagc

SEQ ID NO: 58263 - DNA, 70 bp, Artificial Sequence
  Synthetic
gccaagcatttaggtgacactatagtgtaacctcagcaccatgccgtttcagagctatgctggaaacagc

SEQ ID NO: 58264 - DNA, 70 bp, Artificial Sequence
  Synthetic
gccaagcatttaggtgacactatagttacagcaccaagaacccccgtttcagagctatgctggaaacagc

SEQ ID NO: 58265 - DNA, 70 bp, Artificial Sequence
  Synthetic
gccaagcatttaggtgacactatagtagcctccaccctggcctgagtttcagagctatgctggaaacagc

SEQ ID NO: 58266 - DNA, 70 bp, Artificial Sequence
  Synthetic
gccaagcatttaggtgacactatagagacctgttctgtcagtgaagtttcagagctatgctggaaacagc

SEQ ID NO: 58267 - DNA, 70 bp, Artificial Sequence
  Synthetic
gccaagcatttaggtgacactatagacatggtgggatcgaattttgtttcagagctatgctggaaacagc

SEQ ID NO: 58268 - DNA, 70 bp, Artificial Sequence
  Synthetic
gccaagcatttaggtgacactataggatgatcagttgagtttagcgtttcagagctatgctggaaacagc

SEQ ID NO: 58269 - DNA, 70 bp, Artificial Sequence
  Synthetic
gccaagcatttaggtgacactatagaaattcgtcaatgcgctgctgtttcagagctatgctggaaacagc

SEQ ID NO: 58270 - DNA, 70 bp, Artificial Sequence
  Synthetic
gccaagcatttaggtgacactatagccaacccacctgatcttaaggtttcagagctatgctggaaacagc

SEQ ID NO: 58271 - DNA, 70 bp, Artificial Sequence
  Synthetic
gccaagcatttaggtgacactatagtgttcacattctgaagatgcgtttcagagctatgctggaaacagc

SEQ ID NO: 58272 - DNA, 70 bp, Artificial Sequence
  Synthetic
gccaagcatttaggtgacactatagaccggcgtgtcctgcccagtgtttcagagctatgctggaaacagc

SEQ ID NO: 58273 - DNA, 70 bp, Artificial Sequence
  Synthetic
gccaagcatttaggtgacactatagagctgctgaatattcagaatgtttcagagctatgctggaaacagc

SEQ ID NO: 58274 - DNA, 70 bp, Artificial Sequence
  Synthetic
gccaagcatttaggtgacactataggaagatggtcagtgtttcctgtttcagagctatgctggaaacagc

SEQ ID NO: 58275 - DNA, 70 bp, Artificial Sequence
  Synthetic
gccaagcatttaggtgacactatagcccggcccaggcagacaaaggtttcagagctatgctggaaacagc

SEQ ID NO: 58276 - DNA, 70 bp, Artificial Sequence
  Synthetic
gccaagcatttaggtgacactatagtagaagagaaagtggacggcgtttcagagctatgctggaaacagc

SEQ ID NO: 58277 - DNA, 70 bp, Artificial Sequence
  Synthetic
gccaagcatttaggtgacactatagcaaggtcatgagactgggttgtttcagagctatgctggaaacagc

SEQ ID NO: 58278 - DNA, 70 bp, Artificial Sequence
  Synthetic
gccaagcatttaggtgacactatagagcccaagaactaagtcaaggtttcagagctatgctggaaacagc

SEQ ID NO: 58279 - DNA, 70 bp, Artificial Sequence
  Synthetic
gccaagcatttaggtgacactatagaatctcatgagcacccacaggtttcagagctatgctggaaacagc

SEQ ID NO: 58280 - DNA, 70 bp, Artificial Sequence
  Synthetic
gccaagcatttaggtgacactatagcagcttcatggatgctggaggtttcagagctatgctggaaacagc

SEQ ID NO: 58281 - DNA, 70 bp, Artificial Sequence
  Synthetic
gccaagcatttaggtgacactatagactgggaactttagtccacggtttcagagctatgctggaaacagc

SEQ ID NO: 58282 - DNA, 70 bp, Artificial Sequence
  Synthetic
gccaagcatttaggtgacactatagcatgtaccacctgacatagagtttcagagctatgctggaaacagc

SEQ ID NO: 58283 - DNA, 70 bp, Artificial Sequence
  Synthetic
gccaagcatttaggtgacactatagggcatgtaccacctgtcctagtttcagagctatgctggaaacagc

SEQ ID NO: 58284 - DNA, 70 bp, Artificial Sequence
  Synthetic
gccaagcatttaggtgacactatagccagggctgcatctgcaaaggtttcagagctatgctggaaacagc

SEQ ID NO: 58285 - DNA, 70 bp, Artificial Sequence
  Synthetic
gccaagcatttaggtgacactatagcccaacatcaggcacagcaggtttcagagctatgctggaaacagc

SEQ ID NO: 58286 - DNA, 70 bp, Artificial Sequence
  Synthetic
gccaagcatttaggtgacactatagtgcagctgctgtgcctgatggtttcagagctatgctggaaacagc

SEQ ID NO: 58287 - DNA, 70 bp, Artificial Sequence
  Synthetic
gccaagcatttaggtgacactatagatggtctggggctgtggctagtttcagagctatgctggaaacagc

SEQ ID NO: 58288 - DNA, 70 bp, Artificial Sequence
  Synthetic
gccaagcatttaggtgacactatagccagggctgtgtttgcaaaggtttcagagctatgctggaaacagc

SEQ ID NO: 58289 - DNA, 70 bp, Artificial Sequence
  Synthetic
gccaagcatttaggtgacactatagctgcatctgcaaaggggcatgtttcagagctatgctggaaacagc

SEQ ID NO: 58290 - DNA, 70 bp, Artificial Sequence
  Synthetic
gccaagcatttaggtgacactatagctgcatccgcaaaggggcttgtttcagagctatgctggaaacagc

SEQ ID NO: 58291 - DNA, 70 bp, Artificial Sequence
  Synthetic
gccaagcatttaggtgacactatagatagaacaagctgcacaaccgtttcagagctatgctggaaacagc

SEQ ID NO: 58292 - DNA, 70 bp, Artificial Sequence
  Synthetic
gccaagcatttaggtgacactatagcccagggctgcatctgcaaagtttcagagctatgctggaaacagc

SEQ ID NO: 58293 - DNA, 70 bp, Artificial Sequence
  Synthetic
gccaagcatttaggtgacactatagctgcatctgcaaaggggcgtgtttcagagctatgctggaaacagc

SEQ ID NO: 58294 - DNA, 70 bp, Artificial Sequence
  Synthetic
gccaagcatttaggtgacactatagaggtctcagggtccatgtcggtttcagagctatgctggaaacagc

SEQ ID NO: 58295 - DNA, 70 bp, Artificial Sequence
  Synthetic
gccaagcatttaggtgacactataggcacgatggatggctttcatgtttcagagctatgctggaaacagc

SEQ ID NO: 58296 - DNA, 70 bp, Artificial Sequence
  Synthetic
gccaagcatttaggtgacactatagatgttactgcggtttggtccgtttcagagctatgctggaaacagc

SEQ ID NO: 58297 - DNA, 70 bp, Artificial Sequence
  Synthetic
gccaagcatttaggtgacactatagccatcgtcatcgaggactaggtttcagagctatgctggaaacagc

SEQ ID NO: 58298 - DNA, 70 bp, Artificial Sequence
  Synthetic
gccaagcatttaggtgacactatagccacaggtgctcagtcctccgtttcagagctatgctggaaacagc

SEQ ID NO: 58299 - DNA, 70 bp, Artificial Sequence
  Synthetic
gccaagcatttaggtgacactatagctacagtcatcacaatggtcgtttcagagctatgctggaaacagc

SEQ ID NO: 58300 - DNA, 70 bp, Artificial Sequence
  Synthetic
gccaagcatttaggtgacactatagcatcttacattctgccctaagtttcagagctatgctggaaacagc

SEQ ID NO: 58301 - DNA, 70 bp, Artificial Sequence
  Synthetic
gccaagcatttaggtgacactataggccatgctactttaatgtctgtttcagagctatgctggaaacagc

SEQ ID NO: 58302 - DNA, 70 bp, Artificial Sequence
  Synthetic
gccaagcatttaggtgacactatagagcaaacaacaatgctgtacgtttcagagctatgctggaaacagc

SEQ ID NO: 58303 - DNA, 70 bp, Artificial Sequence
  Synthetic
gccaagcatttaggtgacactatagtagatgattcaggttactccgtttcagagctatgctggaaacagc

SEQ ID NO: 58304 - DNA, 70 bp, Artificial Sequence
  Synthetic
gccaagcatttaggtgacactatagacaacaataagtcttcccaagtttcagagctatgctggaaacagc

SEQ ID NO: 58305 - DNA, 70 bp, Artificial Sequence
  Synthetic
gccaagcatttaggtgacactatagcgggcagggctagagtccccgtttcagagctatgctggaaacagc

SEQ ID NO: 58306 - DNA, 70 bp, Artificial Sequence
  Synthetic
gccaagcatttaggtgacactatagcttttgcctgatgactaaccgtttcagagctatgctggaaacagc

SEQ ID NO: 58307 - DNA, 70 bp, Artificial Sequence
  Synthetic
gccaagcatttaggtgacactatagaaaatttcacgtttctcgtcgtttcagagctatgctggaaacagc

SEQ ID NO: 58308 - DNA, 70 bp, Artificial Sequence
  Synthetic
gccaagcatttaggtgacactatagaagttaagcagatttgcctagtttcagagctatgctggaaacagc

SEQ ID NO: 58309 - DNA, 70 bp, Artificial Sequence
  Synthetic
gccaagcatttaggtgacactatagtcaacatttaatggtgccacgtttcagagctatgctggaaacagc

SEQ ID NO: 58310 - DNA, 70 bp, Artificial Sequence
  Synthetic
gccaagcatttaggtgacactataggtgggaacttgacaatgatggtttcagagctatgctggaaacagc

SEQ ID NO: 58311 - DNA, 70 bp, Artificial Sequence
  Synthetic
gccaagcatttaggtgacactataggattgccaaagcatcagtacgtttcagagctatgctggaaacagc

SEQ ID NO: 58312 - DNA, 70 bp, Artificial Sequence
  Synthetic
gccaagcatttaggtgacactatagctacgctaagcgccctgcccgtttcagagctatgctggaaacagc

SEQ ID NO: 58313 - DNA, 70 bp, Artificial Sequence
  Synthetic
gccaagcatttaggtgacactatagggatgaggacgacgacgagggtttcagagctatgctggaaacagc

SEQ ID NO: 58314 - DNA, 70 bp, Artificial Sequence
  Synthetic
gccaagcatttaggtgacactatagcagcagcttctccaagtgaagtttcagagctatgctggaaacagc

SEQ ID NO: 58315 - DNA, 70 bp, Artificial Sequence
  Synthetic
gccaagcatttaggtgacactatagcagtatcttgtggaatgggagtttcagagctatgctggaaacagc

SEQ ID NO: 58316 - DNA, 70 bp, Artificial Sequence
  Synthetic
gccaagcatttaggtgacactatagtgagagtctgaaatctgcatgtttcagagctatgctggaaacagc

SEQ ID NO: 58317 - DNA, 70 bp, Artificial Sequence
  Synthetic
gccaagcatttaggtgacactatagggtaccagagtatgatcagggtttcagagctatgctggaaacagc

SEQ ID NO: 58318 - DNA, 70 bp, Artificial Sequence
  Synthetic
gccaagcatttaggtgacactataggcacctgggtgggtttgagcgtttcagagctatgctggaaacagc

SEQ ID NO: 58319 - DNA, 70 bp, Artificial Sequence
  Synthetic
gccaagcatttaggtgacactatagaatcctgtatcacctcccttgtttcagagctatgctggaaacagc

SEQ ID NO: 58320 - DNA, 70 bp, Artificial Sequence
  Synthetic
gccaagcatttaggtgacactataggaagccaacaggaaaaatgagtttcagagctatgctggaaacagc

SEQ ID NO: 58321 - DNA, 70 bp, Artificial Sequence
  Synthetic
gccaagcatttaggtgacactatagaaggaggaagtttgctctaagtttcagagctatgctggaaacagc

SEQ ID NO: 58322 - DNA, 70 bp, Artificial Sequence
  Synthetic
gccaagcatttaggtgacactatagagcagctttgcagacatgatgtttcagagctatgctggaaacagc

SEQ ID NO: 58323 - DNA, 70 bp, Artificial Sequence
  Synthetic
gccaagcatttaggtgacactatagacacaagccttctaaactcagtttcagagctatgctggaaacagc

SEQ ID NO: 58324 - DNA, 70 bp, Artificial Sequence
  Synthetic
gccaagcatttaggtgacactataggttcagggcaaagtctcagcgtttcagagctatgctggaaacagc

SEQ ID NO: 58325 - DNA, 70 bp, Artificial Sequence
  Synthetic
gccaagcatttaggtgacactatagagggccgccagccgctcagggtttcagagctatgctggaaacagc

SEQ ID NO: 58326 - DNA, 70 bp, Artificial Sequence
  Synthetic
gccaagcatttaggtgacactatagcctgaaacagaacaggtgaagtttcagagctatgctggaaacagc

SEQ ID NO: 58327 - DNA, 70 bp, Artificial Sequence
  Synthetic
gccaagcatttaggtgacactatagggagtgcaggcgcgtgatctgtttcagagctatgctggaaacagc

SEQ ID NO: 58328 - DNA, 70 bp, Artificial Sequence
  Synthetic
gccaagcatttaggtgacactatagagttaaaggcttgttctaaggtttcagagctatgctggaaacagc

SEQ ID NO: 58329 - DNA, 70 bp, Artificial Sequence
  Synthetic
gccaagcatttaggtgacactataggctgaagtctaaagagcttggtttcagagctatgctggaaacagc

SEQ ID NO: 58330 - DNA, 70 bp, Artificial Sequence
  Synthetic
gccaagcatttaggtgacactataggtgcccatgaaaagatcatcgtttcagagctatgctggaaacagc

SEQ ID NO: 58331 - DNA, 70 bp, Artificial Sequence
  Synthetic
gccaagcatttaggtgacactatagaaaaaagatgactgtggatggtttcagagctatgctggaaacagc

SEQ ID NO: 58332 - DNA, 70 bp, Artificial Sequence
  Synthetic
gccaagcatttaggtgacactatagtgatttttttagctgccagagtttcagagctatgctggaaacagc

SEQ ID NO: 58333 - DNA, 70 bp, Artificial Sequence
  Synthetic
gccaagcatttaggtgacactatagtttcccatgctggagtgcaggtttcagagctatgctggaaacagc

SEQ ID NO: 58334 - DNA, 70 bp, Artificial Sequence
  Synthetic
gccaagcatttaggtgacactatagccagaatgcgagagaaacgggtttcagagctatgctggaaacagc

SEQ ID NO: 58335 - DNA, 70 bp, Artificial Sequence
  Synthetic
gccaagcatttaggtgacactatagggcgctggccaggcagcagagtttcagagctatgctggaaacagc

SEQ ID NO: 58336 - DNA, 70 bp, Artificial Sequence
  Synthetic
gccaagcatttaggtgacactataggccaagacttcttgggatccgtttcagagctatgctggaaacagc

SEQ ID NO: 58337 - DNA, 70 bp, Artificial Sequence
  Synthetic
gccaagcatttaggtgacactataggacactttgaacaaagaccagtttcagagctatgctggaaacagc

SEQ ID NO: 58338 - DNA, 70 bp, Artificial Sequence
  Synthetic
gccaagcatttaggtgacactataggtgcaaactcacttctgagggtttcagagctatgctggaaacagc

SEQ ID NO: 58339 - DNA, 70 bp, Artificial Sequence
  Synthetic
gccaagcatttaggtgacactatagacttcctagttcattccatggtttcagagctatgctggaaacagc

SEQ ID NO: 58340 - DNA, 70 bp, Artificial Sequence
  Synthetic
gccaagcatttaggtgacactatagcgtccacacctcggtctgatgtttcagagctatgctggaaacagc

SEQ ID NO: 58341 - DNA, 70 bp, Artificial Sequence
  Synthetic
gccaagcatttaggtgacactatagttttaagtggggccaaaatagtttcagagctatgctggaaacagc

SEQ ID NO: 58342 - DNA, 70 bp, Artificial Sequence
  Synthetic
gccaagcatttaggtgacactatagcagagggggatctggggtaggtttcagagctatgctggaaacagc

SEQ ID NO: 58343 - DNA, 70 bp, Artificial Sequence
  Synthetic
gccaagcatttaggtgacactatagttaacatctggttatccagagtttcagagctatgctggaaacagc

SEQ ID NO: 58344 - DNA, 70 bp, Artificial Sequence
  Synthetic
gccaagcatttaggtgacactatagaaacaggtcacacatcccctgtttcagagctatgctggaaacagc

SEQ ID NO: 58345 - DNA, 70 bp, Artificial Sequence
  Synthetic
gccaagcatttaggtgacactatagcatgggctggcttcttcacagtttcagagctatgctggaaacagc

SEQ ID NO: 58346 - DNA, 70 bp, Artificial Sequence
  Synthetic
gccaagcatttaggtgacactatagacaggagtgacacactgtgcgtttcagagctatgctggaaacagc

SEQ ID NO: 58347 - DNA, 70 bp, Artificial Sequence
  Synthetic
gccaagcatttaggtgacactatagccaggtcactgagcttcagtgtttcagagctatgctggaaacagc

SEQ ID NO: 58348 - DNA, 70 bp, Artificial Sequence
  Synthetic
gccaagcatttaggtgacactataggtttctccccggcattcaacgtttcagagctatgctggaaacagc

SEQ ID NO: 58349 - DNA, 70 bp, Artificial Sequence
  Synthetic
gccaagcatttaggtgacactatagggtcagcttagagtatggtggtttcagagctatgctggaaacagc

SEQ ID NO: 58350 - DNA, 70 bp, Artificial Sequence
  Synthetic
gccaagcatttaggtgacactatagacttcaggcagtgagaaacagtttcagagctatgctggaaacagc

SEQ ID NO: 58351 - DNA, 70 bp, Artificial Sequence
  Synthetic
gccaagcatttaggtgacactataggtaactaactcactgatgctgtttcagagctatgctggaaacagc

SEQ ID NO: 58352 - DNA, 70 bp, Artificial Sequence
  Synthetic
gccaagcatttaggtgacactataggatgcaggagagtccctgaagtttcagagctatgctggaaacagc

SEQ ID NO: 58353 - DNA, 70 bp, Artificial Sequence
  Synthetic
gccaagcatttaggtgacactatagacattattgttggtcatcaggtttcagagctatgctggaaacagc

SEQ ID NO: 58354 - DNA, 70 bp, Artificial Sequence
  Synthetic
gccaagcatttaggtgacactatagcaggcagatgctctctagccgtttcagagctatgctggaaacagc

SEQ ID NO: 58355 - DNA, 70 bp, Artificial Sequence
  Synthetic
gccaagcatttaggtgacactataggaccactcaacgaagacagtgtttcagagctatgctggaaacagc

SEQ ID NO: 58356 - DNA, 70 bp, Artificial Sequence
  Synthetic
gccaagcatttaggtgacactatagtgggcctccagttaccagaagtttcagagctatgctggaaacagc

SEQ ID NO: 58357 - DNA, 70 bp, Artificial Sequence
  Synthetic
gccaagcatttaggtgacactatagactaattgttctcttcccacgtttcagagctatgctggaaacagc

SEQ ID NO: 58358 - DNA, 70 bp, Artificial Sequence
  Synthetic
gccaagcatttaggtgacactatagaaatggcttggacccattttgtttcagagctatgctggaaacagc

SEQ ID NO: 58359 - DNA, 70 bp, Artificial Sequence
  Synthetic
gccaagcatttaggtgacactatagagaagccattgctgaactttgtttcagagctatgctggaaacagc

SEQ ID NO: 58360 - DNA, 70 bp, Artificial Sequence
  Synthetic
gccaagcatttaggtgacactatagctcagctgaagcatcaggtagtttcagagctatgctggaaacagc

SEQ ID NO: 58361 - DNA, 70 bp, Artificial Sequence
  Synthetic
gccaagcatttaggtgacactatagctgttggaagatgaactatcgtttcagagctatgctggaaacagc

SEQ ID NO: 58362 - DNA, 70 bp, Artificial Sequence
  Synthetic
gccaagcatttaggtgacactatagtgaacttgtacagtcattgagtttcagagctatgctggaaacagc

SEQ ID NO: 58363 - DNA, 70 bp, Artificial Sequence
  Synthetic
gccaagcatttaggtgacactataggcccagtgacatatgtttaagtttcagagctatgctggaaacagc

SEQ ID NO: 58364 - DNA, 70 bp, Artificial Sequence
  Synthetic
gccaagcatttaggtgacactatagttgacctatccgcgaagagggtttcagagctatgctggaaacagc

SEQ ID NO: 58365 - DNA, 70 bp, Artificial Sequence
  Synthetic
gccaagcatttaggtgacactatagtggtctgatgtaggcttatggtttcagagctatgctggaaacagc

SEQ ID NO: 58366 - DNA, 70 bp, Artificial Sequence
  Synthetic
gccaagcatttaggtgacactatagggaggttgaattatgctccggtttcagagctatgctggaaacagc

SEQ ID NO: 58367 - DNA, 70 bp, Artificial Sequence
  Synthetic
gccaagcatttaggtgacactatagtccaacacaggtatgctctagtttcagagctatgctggaaacagc

SEQ ID NO: 58368 - DNA, 70 bp, Artificial Sequence
  Synthetic
gccaagcatttaggtgacactatagagtgacaagcctacggaggcgtttcagagctatgctggaaacagc

SEQ ID NO: 58369 - DNA, 70 bp, Artificial Sequence
  Synthetic
gccaagcatttaggtgacactatagaaactgacctgcctgtgaaggtttcagagctatgctggaaacagc

SEQ ID NO: 58370 - DNA, 70 bp, Artificial Sequence
  Synthetic
gccaagcatttaggtgacactataggttgaactaggagtctatctgtttcagagctatgctggaaacagc

SEQ ID NO: 58371 - DNA, 70 bp, Artificial Sequence
  Synthetic
gccaagcatttaggtgacactatagtgacctgcccgtgaagaggcgtttcagagctatgctggaaacagc

SEQ ID NO: 58372 - DNA, 70 bp, Artificial Sequence
  Synthetic
gccaagcatttaggtgacactatagcaactgacctgcccgtgaaggtttcagagctatgctggaaacagc

SEQ ID NO: 58373 - DNA, 70 bp, Artificial Sequence
  Synthetic
gccaagcatttaggtgacactatagaacgctaccttcaggatattgtttcagagctatgctggaaacagc

SEQ ID NO: 58374 - DNA, 70 bp, Artificial Sequence
  Synthetic
gccaagcatttaggtgacactatagctcagcccctcgcttttcttgtttcagagctatgctggaaacagc

SEQ ID NO: 58375 - DNA, 70 bp, Artificial Sequence
  Synthetic
gccaagcatttaggtgacactatagcggcgccccgcatcttatgagtttcagagctatgctggaaacagc

SEQ ID NO: 58376 - DNA, 70 bp, Artificial Sequence
  Synthetic
gccaagcatttaggtgacactatagtcagtttcaaaaccatccgcgtttcagagctatgctggaaacagc

SEQ ID NO: 58377 - DNA, 70 bp, Artificial Sequence
  Synthetic
gccaagcatttaggtgacactatagggagcccccagatttactgcgtttcagagctatgctggaaacagc

SEQ ID NO: 58378 - DNA, 70 bp, Artificial Sequence
  Synthetic
gccaagcatttaggtgacactataggactttggggaggtgtcatcgtttcagagctatgctggaaacagc

SEQ ID NO: 58379 - DNA, 70 bp, Artificial Sequence
  Synthetic
gccaagcatttaggtgacactatagggccgtgtagtggcgtcatcgtttcagagctatgctggaaacagc

SEQ ID NO: 58380 - DNA, 70 bp, Artificial Sequence
  Synthetic
gccaagcatttaggtgacactatagcatggctgaggaggatgaaggtttcagagctatgctggaaacagc

SEQ ID NO: 58381 - DNA, 70 bp, Artificial Sequence
  Synthetic
gccaagcatttaggtgacactatagaccagtgcgtcaagttcagtgtttcagagctatgctggaaacagc

SEQ ID NO: 58382 - DNA, 70 bp, Artificial Sequence
  Synthetic
gccaagcatttaggtgacactatagttgaagatcgtggtaaaggcgtttcagagctatgctggaaacagc

SEQ ID NO: 58383 - DNA, 70 bp, Artificial Sequence
  Synthetic
gccaagcatttaggtgacactatagacatcctgagcagttattttgtttcagagctatgctggaaacagc

SEQ ID NO: 58384 - DNA, 70 bp, Artificial Sequence
  Synthetic
gccaagcatttaggtgacactatagactctcagggcgaaagccgtgtttcagagctatgctggaaacagc

SEQ ID NO: 58385 - DNA, 70 bp, Artificial Sequence
  Synthetic
gccaagcatttaggtgacactatagccacttctgccaacttgtaggtttcagagctatgctggaaacagc

SEQ ID NO: 58386 - DNA, 70 bp, Artificial Sequence
  Synthetic
gccaagcatttaggtgacactataggctacgatcggtactgctaggtttcagagctatgctggaaacagc

SEQ ID NO: 58387 - DNA, 70 bp, Artificial Sequence
  Synthetic
gccaagcatttaggtgacactataggcccccgttggctcacacaggtttcagagctatgctggaaacagc

SEQ ID NO: 58388 - DNA, 70 bp, Artificial Sequence
  Synthetic
gccaagcatttaggtgacactatagcatgctgctgtgtcttgaatgtttcagagctatgctggaaacagc

SEQ ID NO: 58389 - DNA, 70 bp, Artificial Sequence
  Synthetic
gccaagcatttaggtgacactatagttctatacagaagtacgaaggtttcagagctatgctggaaacagc

SEQ ID NO: 58390 - DNA, 70 bp, Artificial Sequence
  Synthetic
gccaagcatttaggtgacactatagcctggaggatctgcaatgacgtttcagagctatgctggaaacagc

SEQ ID NO: 58391 - DNA, 70 bp, Artificial Sequence
  Synthetic
gccaagcatttaggtgacactatagaatgatgtcgtcattacctggtttcagagctatgctggaaacagc

SEQ ID NO: 58392 - DNA, 70 bp, Artificial Sequence
  Synthetic
gccaagcatttaggtgacactatagtcagcattaactgtacatgagtttcagagctatgctggaaacagc

SEQ ID NO: 58393 - DNA, 70 bp, Artificial Sequence
  Synthetic
gccaagcatttaggtgacactatagcatctggggagcgggtgagcgtttcagagctatgctggaaacagc

SEQ ID NO: 58394 - DNA, 70 bp, Artificial Sequence
  Synthetic
gccaagcatttaggtgacactatagtgcgtgtcaggagaggctaagtttcagagctatgctggaaacagc

SEQ ID NO: 58395 - DNA, 70 bp, Artificial Sequence
  Synthetic
gccaagcatttaggtgacactatagagatgagcgggaggaacagcgtttcagagctatgctggaaacagc

SEQ ID NO: 58396 - DNA, 70 bp, Artificial Sequence
  Synthetic
gccaagcatttaggtgacactatagccactccatggtgtcctcaggtttcagagctatgctggaaacagc

SEQ ID NO: 58397 - DNA, 70 bp, Artificial Sequence
  Synthetic
gccaagcatttaggtgacactataggccccgcagggctcacactggtttcagagctatgctggaaacagc

SEQ ID NO: 58398 - DNA, 70 bp, Artificial Sequence
  Synthetic
gccaagcatttaggtgacactataggctgaggccttgccttgaaggtttcagagctatgctggaaacagc

SEQ ID NO: 58399 - DNA, 70 bp, Artificial Sequence
  Synthetic
gccaagcatttaggtgacactatagcggcagtgctggtcagtgcagtttcagagctatgctggaaacagc

SEQ ID NO: 58400 - DNA, 70 bp, Artificial Sequence
  Synthetic
gccaagcatttaggtgacactatagagaacgttctcagacagcaggtttcagagctatgctggaaacagc

SEQ ID NO: 58401 - DNA, 70 bp, Artificial Sequence
  Synthetic
gccaagcatttaggtgacactataggtggcctgtggagactagcagtttcagagctatgctggaaacagc

SEQ ID NO: 58402 - DNA, 70 bp, Artificial Sequence
  Synthetic
gccaagcatttaggtgacactatagcagaattattgacgacatgggtttcagagctatgctggaaacagc

SEQ ID NO: 58403 - DNA, 70 bp, Artificial Sequence
  Synthetic
gccaagcatttaggtgacactatagggtagagtgtgtccctgagagtttcagagctatgctggaaacagc

SEQ ID NO: 58404 - DNA, 70 bp, Artificial Sequence
  Synthetic
gccaagcatttaggtgacactatagaactattagctgttgtacaggtttcagagctatgctggaaacagc

SEQ ID NO: 58405 - DNA, 70 bp, Artificial Sequence
  Synthetic
gccaagcatttaggtgacactatagggaaccggcgccgtcggtgagtttcagagctatgctggaaacagc

SEQ ID NO: 58406 - DNA, 70 bp, Artificial Sequence
  Synthetic
gccaagcatttaggtgacactatagaggaccatgtctaggctacagtttcagagctatgctggaaacagc

SEQ ID NO: 58407 - DNA, 70 bp, Artificial Sequence
  Synthetic
gccaagcatttaggtgacactatagcacggcataagctcaggtcagtttcagagctatgctggaaacagc

SEQ ID NO: 58408 - DNA, 70 bp, Artificial Sequence
  Synthetic
gccaagcatttaggtgacactataggagggaactgtgagtgtctagtttcagagctatgctggaaacagc

SEQ ID NO: 58409 - DNA, 70 bp, Artificial Sequence
  Synthetic
gccaagcatttaggtgacactatagggacccaccaagagtgtcttgtttcagagctatgctggaaacagc

SEQ ID NO: 58410 - DNA, 70 bp, Artificial Sequence
  Synthetic
gccaagcatttaggtgacactatagaatatcatcaagcacctgaagtttcagagctatgctggaaacagc

SEQ ID NO: 58411 - DNA, 70 bp, Artificial Sequence
  Synthetic
gccaagcatttaggtgacactatagggggctttcagaggtgtcacgtttcagagctatgctggaaacagc

SEQ ID NO: 58412 - DNA, 70 bp, Artificial Sequence
  Synthetic
gccaagcatttaggtgacactatagggtgagggactatgagacgcgtttcagagctatgctggaaacagc

SEQ ID NO: 58413 - DNA, 70 bp, Artificial Sequence
  Synthetic
gccaagcatttaggtgacactatagcaccccgacaaggcctcaccgtttcagagctatgctggaaacagc

SEQ ID NO: 58414 - DNA, 70 bp, Artificial Sequence
  Synthetic
gccaagcatttaggtgacactatagcagcagatcccgcagtcctggtttcagagctatgctggaaacagc

SEQ ID NO: 58415 - DNA, 70 bp, Artificial Sequence
  Synthetic
gccaagcatttaggtgacactatagtgctgaggcagtcaggcagcgtttcagagctatgctggaaacagc

SEQ ID NO: 58416 - DNA, 70 bp, Artificial Sequence
  Synthetic
gccaagcatttaggtgacactataggtgtcgtgggctcctctcaggtttcagagctatgctggaaacagc

SEQ ID NO: 58417 - DNA, 70 bp, Artificial Sequence
  Synthetic
gccaagcatttaggtgacactatagatcaggagttagcgcagtacgtttcagagctatgctggaaacagc

SEQ ID NO: 58418 - DNA, 70 bp, Artificial Sequence
  Synthetic
gccaagcatttaggtgacactatagcagtgtgcgtgcacgtctacgtttcagagctatgctggaaacagc

SEQ ID NO: 58419 - DNA, 70 bp, Artificial Sequence
  Synthetic
gccaagcatttaggtgacactatagctggacagagtgtggttaacgtttcagagctatgctggaaacagc

SEQ ID NO: 58420 - DNA, 70 bp, Artificial Sequence
  Synthetic
gccaagcatttaggtgacactatagcaggcatcgccgcccttcaggtttcagagctatgctggaaacagc

SEQ ID NO: 58421 - DNA, 70 bp, Artificial Sequence
  Synthetic
gccaagcatttaggtgacactataggacagtcacaaggcgtgtctgtttcagagctatgctggaaacagc

SEQ ID NO: 58422 - DNA, 70 bp, Artificial Sequence
  Synthetic
gccaagcatttaggtgacactatagacggccaacagtgtcagtgagtttcagagctatgctggaaacagc

SEQ ID NO: 58423 - DNA, 70 bp, Artificial Sequence
  Synthetic
gccaagcatttaggtgacactataggggtgaggaacatcatagccgtttcagagctatgctggaaacagc

SEQ ID NO: 58424 - DNA, 70 bp, Artificial Sequence
  Synthetic
gccaagcatttaggtgacactatagagagggcacgggcctacgaggtttcagagctatgctggaaacagc

SEQ ID NO: 58425 - DNA, 70 bp, Artificial Sequence
  Synthetic
gccaagcatttaggtgacactatagagtgaatgaaagtttgacacgtttcagagctatgctggaaacagc

SEQ ID NO: 58426 - DNA, 70 bp, Artificial Sequence
  Synthetic
gccaagcatttaggtgacactatagaatccacatttcagaagacggtttcagagctatgctggaaacagc

SEQ ID NO: 58427 - DNA, 70 bp, Artificial Sequence
  Synthetic
gccaagcatttaggtgacactataggaccaaagaggagctggagggtttcagagctatgctggaaacagc

SEQ ID NO: 58428 - DNA, 70 bp, Artificial Sequence
  Synthetic
gccaagcatttaggtgacactatagcagtctacatgtcgtagagcgtttcagagctatgctggaaacagc

SEQ ID NO: 58429 - DNA, 70 bp, Artificial Sequence
  Synthetic
gccaagcatttaggtgacactatagggacctaaggaacttgctacgtttcagagctatgctggaaacagc

SEQ ID NO: 58430 - DNA, 70 bp, Artificial Sequence
  Synthetic
gccaagcatttaggtgacactataggaatgtcttcaggcccccaggtttcagagctatgctggaaacagc

SEQ ID NO: 58431 - DNA, 70 bp, Artificial Sequence
  Synthetic
gccaagcatttaggtgacactatagaaggagaactgcaaataggggtttcagagctatgctggaaacagc

SEQ ID NO: 58432 - DNA, 70 bp, Artificial Sequence
  Synthetic
gccaagcatttaggtgacactatagtgcccacctggtttttgtcagtttcagagctatgctggaaacagc

SEQ ID NO: 58433 - DNA, 70 bp, Artificial Sequence
  Synthetic
gccaagcatttaggtgacactataggggctgccactgtgggctacgtttcagagctatgctggaaacagc

SEQ ID NO: 58434 - DNA, 70 bp, Artificial Sequence
  Synthetic
gccaagcatttaggtgacactatagtgtctcacatgaccagcgtcgtttcagagctatgctggaaacagc

SEQ ID NO: 58435 - DNA, 70 bp, Artificial Sequence
  Synthetic
gccaagcatttaggtgacactatagtcccagcctgcttcagagtggtttcagagctatgctggaaacagc

SEQ ID NO: 58436 - DNA, 70 bp, Artificial Sequence
  Synthetic
gccaagcatttaggtgacactatagaagcacaggtgaggaaggcagtttcagagctatgctggaaacagc

SEQ ID NO: 58437 - DNA, 70 bp, Artificial Sequence
  Synthetic
gccaagcatttaggtgacactataggagagctcttgaagtactacgtttcagagctatgctggaaacagc

SEQ ID NO: 58438 - DNA, 70 bp, Artificial Sequence
  Synthetic
gccaagcatttaggtgacactatagcggaccctcatcttgtcctggtttcagagctatgctggaaacagc

SEQ ID NO: 58439 - DNA, 70 bp, Artificial Sequence
  Synthetic
gccaagcatttaggtgacactatagggagattgaatgcaaactgggtttcagagctatgctggaaacagc

SEQ ID NO: 58440 - DNA, 70 bp, Artificial Sequence
  Synthetic
gccaagcatttaggtgacactataggacaaccagtcttcctggaggtttcagagctatgctggaaacagc

SEQ ID NO: 58441 - DNA, 70 bp, Artificial Sequence
  Synthetic
gccaagcatttaggtgacactataggcaatcctgaggaatactgagtttcagagctatgctggaaacagc

SEQ ID NO: 58442 - DNA, 70 bp, Artificial Sequence
  Synthetic
gccaagcatttaggtgacactatagttctgcagactcctcttgcagtttcagagctatgctggaaacagc

SEQ ID NO: 58443 - DNA, 70 bp, Artificial Sequence
  Synthetic
gccaagcatttaggtgacactataggtaggggacaggtctcactggtttcagagctatgctggaaacagc

SEQ ID NO: 58444 - DNA, 70 bp, Artificial Sequence
  Synthetic
gccaagcatttaggtgacactatagaggagccagcctggtcactggtttcagagctatgctggaaacagc

SEQ ID NO: 58445 - DNA, 70 bp, Artificial Sequence
  Synthetic
gccaagcatttaggtgacactatagcctcccgtgacttcagtgtggtttcagagctatgctggaaacagc

SEQ ID NO: 58446 - DNA, 70 bp, Artificial Sequence
  Synthetic
gccaagcatttaggtgacactatagcttcttaggtgtcctcaattgtttcagagctatgctggaaacagc

SEQ ID NO: 58447 - DNA, 70 bp, Artificial Sequence
  Synthetic
gccaagcatttaggtgacactatagctacggaactcttgtgcgtagtttcagagctatgctggaaacagc

SEQ ID NO: 58448 - DNA, 70 bp, Artificial Sequence
  Synthetic
gccaagcatttaggtgacactatagggaggagaagcgtgctgaatgtttcagagctatgctggaaacagc

SEQ ID NO: 58449 - DNA, 70 bp, Artificial Sequence
  Synthetic
gccaagcatttaggtgacactatagtctgcgtgttctaaaaagtggtttcagagctatgctggaaacagc

SEQ ID NO: 58450 - DNA, 70 bp, Artificial Sequence
  Synthetic
gccaagcatttaggtgacactatagggcccgagagtcacctgcaggtttcagagctatgctggaaacagc

SEQ ID NO: 58451 - DNA, 70 bp, Artificial Sequence
  Synthetic
gccaagcatttaggtgacactataggggcagcttcagccaaagaggtttcagagctatgctggaaacagc

SEQ ID NO: 58452 - DNA, 70 bp, Artificial Sequence
  Synthetic
gccaagcatttaggtgacactatagtggtcagttagtagccagtggtttcagagctatgctggaaacagc

SEQ ID NO: 58453 - DNA, 70 bp, Artificial Sequence
  Synthetic
gccaagcatttaggtgacactataggctggaaaaggaaaaattgcgtttcagagctatgctggaaacagc

SEQ ID NO: 58454 - DNA, 70 bp, Artificial Sequence
  Synthetic
gccaagcatttaggtgacactatagttgaaactggaaacatccaggtttcagagctatgctggaaacagc

SEQ ID NO: 58455 - DNA, 70 bp, Artificial Sequence
  Synthetic
gccaagcatttaggtgacactataggcattcccagattcctgagtgtttcagagctatgctggaaacagc

SEQ ID NO: 58456 - DNA, 70 bp, Artificial Sequence
  Synthetic
gccaagcatttaggtgacactatagctcagaacagtcttcagggcgtttcagagctatgctggaaacagc

SEQ ID NO: 58457 - DNA, 70 bp, Artificial Sequence
  Synthetic
gccaagcatttaggtgacactatagtggggatcagtcgcttctgagtttcagagctatgctggaaacagc

SEQ ID NO: 58458 - DNA, 70 bp, Artificial Sequence
  Synthetic
gccaagcatttaggtgacactatagcagctcagtgcgcgatgcctgtttcagagctatgctggaaacagc

SEQ ID NO: 58459 - DNA, 70 bp, Artificial Sequence
  Synthetic
gccaagcatttaggtgacactatagcagagaaattgatgttcgctgtttcagagctatgctggaaacagc

SEQ ID NO: 58460 - DNA, 70 bp, Artificial Sequence
  Synthetic
gccaagcatttaggtgacactatagatcatcatcctcacttgttggtttcagagctatgctggaaacagc

SEQ ID NO: 58461 - DNA, 70 bp, Artificial Sequence
  Synthetic
gccaagcatttaggtgacactatagtagcacatgatagataagccgtttcagagctatgctggaaacagc

SEQ ID NO: 58462 - DNA, 70 bp, Artificial Sequence
  Synthetic
gccaagcatttaggtgacactatagcccctgcgtggaggaagtgggtttcagagctatgctggaaacagc

SEQ ID NO: 58463 - DNA, 70 bp, Artificial Sequence
  Synthetic
gccaagcatttaggtgacactataggctgagggtgaagagcaggggtttcagagctatgctggaaacagc

SEQ ID NO: 58464 - DNA, 70 bp, Artificial Sequence
  Synthetic
gccaagcatttaggtgacactatagtcctgcaactttactctgacgtttcagagctatgctggaaacagc

SEQ ID NO: 58465 - DNA, 70 bp, Artificial Sequence
  Synthetic
gccaagcatttaggtgacactatagagttgcttattcactggcctgtttcagagctatgctggaaacagc

SEQ ID NO: 58466 - DNA, 70 bp, Artificial Sequence
  Synthetic
gccaagcatttaggtgacactatagcatcactgcgaagtttcctggtttcagagctatgctggaaacagc

SEQ ID NO: 58467 - DNA, 70 bp, Artificial Sequence
  Synthetic
gccaagcatttaggtgacactatagagggccaagagccgagacgtgtttcagagctatgctggaaacagc

SEQ ID NO: 58468 - DNA, 70 bp, Artificial Sequence
  Synthetic
gccaagcatttaggtgacactatagtggggacagggtagggtcacgtttcagagctatgctggaaacagc

SEQ ID NO: 58469 - DNA, 70 bp, Artificial Sequence
  Synthetic
gccaagcatttaggtgacactatagagcaagagagtttgggaaaagtttcagagctatgctggaaacagc

SEQ ID NO: 58470 - DNA, 70 bp, Artificial Sequence
  Synthetic
gccaagcatttaggtgacactatagtgacttttgtgtgaacctccgtttcagagctatgctggaaacagc

SEQ ID NO: 58471 - DNA, 70 bp, Artificial Sequence
  Synthetic
gccaagcatttaggtgacactatagtggctcactcttcactctcggtttcagagctatgctggaaacagc

SEQ ID NO: 58472 - DNA, 70 bp, Artificial Sequence
  Synthetic
gccaagcatttaggtgacactataggctgagagtgaagagtcggggtttcagagctatgctggaaacagc

SEQ ID NO: 58473 - DNA, 70 bp, Artificial Sequence
  Synthetic
gccaagcatttaggtgacactatagcgagccaagagccgtgacatgtttcagagctatgctggaaacagc

SEQ ID NO: 58474 - DNA, 70 bp, Artificial Sequence
  Synthetic
gccaagcatttaggtgacactataggagccgtgacattggcacgagtttcagagctatgctggaaacagc

SEQ ID NO: 58475 - DNA, 70 bp, Artificial Sequence
  Synthetic
gccaagcatttaggtgacactataggcacggacccgggacgccctgtttcagagctatgctggaaacagc

SEQ ID NO: 58476 - DNA, 70 bp, Artificial Sequence
  Synthetic
gccaagcatttaggtgacactatagtgatttttgtgtgaacctctgtttcagagctatgctggaaacagc

SEQ ID NO: 58477 - DNA, 70 bp, Artificial Sequence
  Synthetic
gccaagcatttaggtgacactatagtgcaggagaagaggcttattgtttcagagctatgctggaaacagc

SEQ ID NO: 58478 - DNA, 70 bp, Artificial Sequence
  Synthetic
gccaagcatttaggtgacactataggcacatcatgtctatctgaagtttcagagctatgctggaaacagc

SEQ ID NO: 58479 - DNA, 70 bp, Artificial Sequence
  Synthetic
gccaagcatttaggtgacactatagacggtgaagagaaggattaggtttcagagctatgctggaaacagc

SEQ ID NO: 58480 - DNA, 70 bp, Artificial Sequence
  Synthetic
gccaagcatttaggtgacactatagttcacacgcatcctgaaacagtttcagagctatgctggaaacagc

SEQ ID NO: 58481 - DNA, 70 bp, Artificial Sequence
  Synthetic
gccaagcatttaggtgacactatagggagaagagaaggactaggagtttcagagctatgctggaaacagc

SEQ ID NO: 58482 - DNA, 70 bp, Artificial Sequence
  Synthetic
gccaagcatttaggtgacactatagttcatagttgatgcagccatgtttcagagctatgctggaaacagc

SEQ ID NO: 58483 - DNA, 70 bp, Artificial Sequence
  Synthetic
gccaagcatttaggtgacactatagttgtcaagcacatcatgtcagtttcagagctatgctggaaacagc

SEQ ID NO: 58484 - DNA, 70 bp, Artificial Sequence
  Synthetic
gccaagcatttaggtgacactatagcacccacggggaggagaagggtttcagagctatgctggaaacagc

SEQ ID NO: 58485 - DNA, 70 bp, Artificial Sequence
  Synthetic
gccaagcatttaggtgacactataggcatatcctgtcggggtgacgtttcagagctatgctggaaacagc

SEQ ID NO: 58486 - DNA, 70 bp, Artificial Sequence
  Synthetic
gccaagcatttaggtgacactatagcgcatggtgctgaatggctggtttcagagctatgctggaaacagc

SEQ ID NO: 58487 - DNA, 70 bp, Artificial Sequence
  Synthetic
gccaagcatttaggtgacactataggcttaggatgtgtttcaagagtttcagagctatgctggaaacagc

SEQ ID NO: 58488 - DNA, 70 bp, Artificial Sequence
  Synthetic
gccaagcatttaggtgacactatagagacgagaaagaggaatgaggtttcagagctatgctggaaacagc

SEQ ID NO: 58489 - DNA, 70 bp, Artificial Sequence
  Synthetic
gccaagcatttaggtgacactatagcgccaaggataaagacgactgtttcagagctatgctggaaacagc

SEQ ID NO: 58490 - DNA, 70 bp, Artificial Sequence
  Synthetic
gccaagcatttaggtgacactatagtgggaacatctgcctcagctgtttcagagctatgctggaaacagc

SEQ ID NO: 58491 - DNA, 70 bp, Artificial Sequence
  Synthetic
gccaagcatttaggtgacactatagtacagtcagattgagaagacgtttcagagctatgctggaaacagc

SEQ ID NO: 58492 - DNA, 70 bp, Artificial Sequence
  Synthetic
gccaagcatttaggtgacactatagaggtgaaggggaaggggaaggtttcagagctatgctggaaacagc

SEQ ID NO: 58493 - DNA, 70 bp, Artificial Sequence
  Synthetic
gccaagcatttaggtgacactataggggggcactgatggctctgggtttcagagctatgctggaaacagc

SEQ ID NO: 58494 - DNA, 70 bp, Artificial Sequence
  Synthetic
gccaagcatttaggtgacactataggttgaagattagggagaagtgtttcagagctatgctggaaacagc

SEQ ID NO: 58495 - DNA, 70 bp, Artificial Sequence
  Synthetic
gccaagcatttaggtgacactataggctgcctcctgtagactattgtttcagagctatgctggaaacagc

SEQ ID NO: 58496 - DNA, 70 bp, Artificial Sequence
  Synthetic
gccaagcatttaggtgacactatagacgccaaggaccaggagtaggtttcagagctatgctggaaacagc

SEQ ID NO: 58497 - DNA, 70 bp, Artificial Sequence
  Synthetic
gccaagcatttaggtgacactatagatcagacacaagcacagcacgtttcagagctatgctggaaacagc

SEQ ID NO: 58498 - DNA, 70 bp, Artificial Sequence
  Synthetic
gccaagcatttaggtgacactatagaggttaggcccccaaaagtggtttcagagctatgctggaaacagc

SEQ ID NO: 58499 - DNA, 70 bp, Artificial Sequence
  Synthetic
gccaagcatttaggtgacactatagtgttgaggtcaactgtgaatgtttcagagctatgctggaaacagc

SEQ ID NO: 58500 - DNA, 70 bp, Artificial Sequence
  Synthetic
gccaagcatttaggtgacactatagggctctgtcccgccttcaccgtttcagagctatgctggaaacagc

SEQ ID NO: 58501 - DNA, 70 bp, Artificial Sequence
  Synthetic
gccaagcatttaggtgacactataggctgggggctgggtcagagcgtttcagagctatgctggaaacagc

SEQ ID NO: 58502 - DNA, 70 bp, Artificial Sequence
  Synthetic
gccaagcatttaggtgacactataggtggcccagcatcaactgaggtttcagagctatgctggaaacagc

SEQ ID NO: 58503 - DNA, 70 bp, Artificial Sequence
  Synthetic
gccaagcatttaggtgacactatagtgggacaccaccatttgatggtttcagagctatgctggaaacagc

SEQ ID NO: 58504 - DNA, 70 bp, Artificial Sequence
  Synthetic
gccaagcatttaggtgacactatagcgacacagaggccaagctgagtttcagagctatgctggaaacagc

SEQ ID NO: 58505 - DNA, 70 bp, Artificial Sequence
  Synthetic
gccaagcatttaggtgacactataggaagaaatacctccagaagtgtttcagagctatgctggaaacagc

SEQ ID NO: 58506 - DNA, 70 bp, Artificial Sequence
  Synthetic
gccaagcatttaggtgacactatagcagggaaaagctctatgcaagtttcagagctatgctggaaacagc

SEQ ID NO: 58507 - DNA, 70 bp, Artificial Sequence
  Synthetic
gccaagcatttaggtgacactatagcttctgccttcactgggctggtttcagagctatgctggaaacagc

SEQ ID NO: 58508 - DNA, 70 bp, Artificial Sequence
  Synthetic
gccaagcatttaggtgacactataggaggtgactgtgcagtgagggtttcagagctatgctggaaacagc

SEQ ID NO: 58509 - DNA, 70 bp, Artificial Sequence
  Synthetic
gccaagcatttaggtgacactatagagagaggaggcgccagttaagtttcagagctatgctggaaacagc

SEQ ID NO: 58510 - DNA, 70 bp, Artificial Sequence
  Synthetic
gccaagcatttaggtgacactatagtcgccccacggctgaattctgtttcagagctatgctggaaacagc

SEQ ID NO: 58511 - DNA, 70 bp, Artificial Sequence
  Synthetic
gccaagcatttaggtgacactatagaccagcgggaagggatccccgtttcagagctatgctggaaacagc

SEQ ID NO: 58512 - DNA, 70 bp, Artificial Sequence
  Synthetic
gccaagcatttaggtgacactatagctccgcggggcgtcagttccgtttcagagctatgctggaaacagc

SEQ ID NO: 58513 - DNA, 70 bp, Artificial Sequence
  Synthetic
gccaagcatttaggtgacactatagtggagaacttgttggagtgcgtttcagagctatgctggaaacagc

SEQ ID NO: 58514 - DNA, 70 bp, Artificial Sequence
  Synthetic
gccaagcatttaggtgacactatagaactatgtgaccaagatctggtttcagagctatgctggaaacagc

SEQ ID NO: 58515 - DNA, 70 bp, Artificial Sequence
  Synthetic
gccaagcatttaggtgacactatagtacgtggagaagatctgagcgtttcagagctatgctggaaacagc

SEQ ID NO: 58516 - DNA, 70 bp, Artificial Sequence
  Synthetic
gccaagcatttaggtgacactatagcggcgggtgcgggcgctcaggtttcagagctatgctggaaacagc

SEQ ID NO: 58517 - DNA, 70 bp, Artificial Sequence
  Synthetic
gccaagcatttaggtgacactatagtcctctatcaggacttcctcgtttcagagctatgctggaaacagc

SEQ ID NO: 58518 - DNA, 70 bp, Artificial Sequence
  Synthetic
gccaagcatttaggtgacactatagcgttgaacggttaggactgcgtttcagagctatgctggaaacagc

SEQ ID NO: 58519 - DNA, 70 bp, Artificial Sequence
  Synthetic
gccaagcatttaggtgacactatagagcaaaagagtctccttttggtttcagagctatgctggaaacagc

SEQ ID NO: 58520 - DNA, 70 bp, Artificial Sequence
  Synthetic
gccaagcatttaggtgacactatagcggcctgggcttcatttcacgtttcagagctatgctggaaacagc

SEQ ID NO: 58521 - DNA, 70 bp, Artificial Sequence
  Synthetic
gccaagcatttaggtgacactatagtgcatcttcagacttcattggtttcagagctatgctggaaacagc

SEQ ID NO: 58522 - DNA, 70 bp, Artificial Sequence
  Synthetic
gccaagcatttaggtgacactatagtcaagctaggctttctgaatgtttcagagctatgctggaaacagc

SEQ ID NO: 58523 - DNA, 70 bp, Artificial Sequence
  Synthetic
gccaagcatttaggtgacactatagctttaacagactctgcagcagtttcagagctatgctggaaacagc

SEQ ID NO: 58524 - DNA, 70 bp, Artificial Sequence
  Synthetic
gccaagcatttaggtgacactatagaccaaaagactttcaggcccgtttcagagctatgctggaaacagc

SEQ ID NO: 58525 - DNA, 70 bp, Artificial Sequence
  Synthetic
gccaagcatttaggtgacactataggactgttcacttgccgctccgtttcagagctatgctggaaacagc

SEQ ID NO: 58526 - DNA, 70 bp, Artificial Sequence
  Synthetic
gccaagcatttaggtgacactatagcagcatccgctgctaggtgcgtttcagagctatgctggaaacagc

SEQ ID NO: 58527 - DNA, 70 bp, Artificial Sequence
  Synthetic
gccaagcatttaggtgacactatagaaccaacagctagcactcttgtttcagagctatgctggaaacagc

SEQ ID NO: 58528 - DNA, 70 bp, Artificial Sequence
  Synthetic
gccaagcatttaggtgacactatagcagctgtggctctcagccatgtttcagagctatgctggaaacagc

SEQ ID NO: 58529 - DNA, 70 bp, Artificial Sequence
  Synthetic
gccaagcatttaggtgacactataggcctcggaaggtcagtattagtttcagagctatgctggaaacagc

SEQ ID NO: 58530 - DNA, 70 bp, Artificial Sequence
  Synthetic
gccaagcatttaggtgacactatagcttggaggcttttcacatctgtttcagagctatgctggaaacagc

SEQ ID NO: 58531 - DNA, 70 bp, Artificial Sequence
  Synthetic
gccaagcatttaggtgacactatagtggaccttcacttgcagcaggtttcagagctatgctggaaacagc

SEQ ID NO: 58532 - DNA, 70 bp, Artificial Sequence
  Synthetic
gccaagcatttaggtgacactataggatataccaggtgctctgaggtttcagagctatgctggaaacagc

SEQ ID NO: 58533 - DNA, 70 bp, Artificial Sequence
  Synthetic
gccaagcatttaggtgacactatagcggcaaagagtagaggagcagtttcagagctatgctggaaacagc

SEQ ID NO: 58534 - DNA, 70 bp, Artificial Sequence
  Synthetic
gccaagcatttaggtgacactataggcttggaagacaatctcagtgtttcagagctatgctggaaacagc

SEQ ID NO: 58535 - DNA, 70 bp, Artificial Sequence
  Synthetic
gccaagcatttaggtgacactatagtggcaagaaggccaagtgacgtttcagagctatgctggaaacagc

SEQ ID NO: 58536 - DNA, 70 bp, Artificial Sequence
  Synthetic
gccaagcatttaggtgacactatagggctaggaaaacgccttcacgtttcagagctatgctggaaacagc

SEQ ID NO: 58537 - DNA, 70 bp, Artificial Sequence
  Synthetic
gccaagcatttaggtgacactatagtcacatgctcttcagctcctgtttcagagctatgctggaaacagc

SEQ ID NO: 58538 - DNA, 70 bp, Artificial Sequence
  Synthetic
gccaagcatttaggtgacactatagtgggctgggtcaggacgcccgtttcagagctatgctggaaacagc

SEQ ID NO: 58539 - DNA, 70 bp, Artificial Sequence
  Synthetic
gccaagcatttaggtgacactatagcagcgtttggcagctcaatcgtttcagagctatgctggaaacagc

SEQ ID NO: 58540 - DNA, 70 bp, Artificial Sequence
  Synthetic
gccaagcatttaggtgacactatagggagaaacagaggagctgtggtttcagagctatgctggaaacagc

SEQ ID NO: 58541 - DNA, 70 bp, Artificial Sequence
  Synthetic
gccaagcatttaggtgacactatagtttcataggtcttctgattcgtttcagagctatgctggaaacagc

SEQ ID NO: 58542 - DNA, 70 bp, Artificial Sequence
  Synthetic
gccaagcatttaggtgacactatagaggctagggctacagctcctgtttcagagctatgctggaaacagc

SEQ ID NO: 58543 - DNA, 70 bp, Artificial Sequence
  Synthetic
gccaagcatttaggtgacactatagatgctcttctcggagtgtaggtttcagagctatgctggaaacagc

SEQ ID NO: 58544 - DNA, 70 bp, Artificial Sequence
  Synthetic
gccaagcatttaggtgacactataggatttcacggagatttccatgtttcagagctatgctggaaacagc

SEQ ID NO: 58545 - DNA, 70 bp, Artificial Sequence
  Synthetic
gccaagcatttaggtgacactatagggagggcagctcagtcacacgtttcagagctatgctggaaacagc

SEQ ID NO: 58546 - DNA, 70 bp, Artificial Sequence
  Synthetic
gccaagcatttaggtgacactatagtcaactgatccttattttgcgtttcagagctatgctggaaacagc

SEQ ID NO: 58547 - DNA, 70 bp, Artificial Sequence
  Synthetic
gccaagcatttaggtgacactatagatcacagctgactccagagcgtttcagagctatgctggaaacagc

SEQ ID NO: 58548 - DNA, 70 bp, Artificial Sequence
  Synthetic
gccaagcatttaggtgacactatagaaccgaagagaactgtacaagtttcagagctatgctggaaacagc

SEQ ID NO: 58549 - DNA, 70 bp, Artificial Sequence
  Synthetic
gccaagcatttaggtgacactatagggtaccacacggcctagaccgtttcagagctatgctggaaacagc

SEQ ID NO: 58550 - DNA, 70 bp, Artificial Sequence
  Synthetic
gccaagcatttaggtgacactataggctcagtcacttaccatgtggtttcagagctatgctggaaacagc

SEQ ID NO: 58551 - DNA, 70 bp, Artificial Sequence
  Synthetic
gccaagcatttaggtgacactataggcaggctgtgagaggaattcgtttcagagctatgctggaaacagc

SEQ ID NO: 58552 - DNA, 70 bp, Artificial Sequence
  Synthetic
gccaagcatttaggtgacactatagtaacatccagctgccgcacagtttcagagctatgctggaaacagc

SEQ ID NO: 58553 - DNA, 70 bp, Artificial Sequence
  Synthetic
gccaagcatttaggtgacactatagttttcttcatggttaactccgtttcagagctatgctggaaacagc

SEQ ID NO: 58554 - DNA, 70 bp, Artificial Sequence
  Synthetic
gccaagcatttaggtgacactatagggactagagctcttctcttggtttcagagctatgctggaaacagc

SEQ ID NO: 58555 - DNA, 70 bp, Artificial Sequence
  Synthetic
gccaagcatttaggtgacactatagggatcttctggtgcctcagcgtttcagagctatgctggaaacagc

SEQ ID NO: 58556 - DNA, 70 bp, Artificial Sequence
  Synthetic
gccaagcatttaggtgacactataggcgtcccggctggagctactgtttcagagctatgctggaaacagc

SEQ ID NO: 58557 - DNA, 70 bp, Artificial Sequence
  Synthetic
gccaagcatttaggtgacactatagcaaggctactgaagcactgagtttcagagctatgctggaaacagc

SEQ ID NO: 58558 - DNA, 70 bp, Artificial Sequence
  Synthetic
gccaagcatttaggtgacactatagacgcagggcagcacctaggagtttcagagctatgctggaaacagc

SEQ ID NO: 58559 - DNA, 70 bp, Artificial Sequence
  Synthetic
gccaagcatttaggtgacactatagacacggggcagcacctaggagtttcagagctatgctggaaacagc

SEQ ID NO: 58560 - DNA, 70 bp, Artificial Sequence
  Synthetic
gccaagcatttaggtgacactatagaggtaacatgtagcctttgcgtttcagagctatgctggaaacagc

SEQ ID NO: 58561 - DNA, 70 bp, Artificial Sequence
  Synthetic
gccaagcatttaggtgacactatagtgcgctttctgccatggtgtgtttcagagctatgctggaaacagc

SEQ ID NO: 58562 - DNA, 70 bp, Artificial Sequence
  Synthetic
gccaagcatttaggtgacactatagagcatgactttcaagcacccgtttcagagctatgctggaaacagc

SEQ ID NO: 58563 - DNA, 70 bp, Artificial Sequence
  Synthetic
gccaagcatttaggtgacactatagagtcacatgtaaggaacatagtttcagagctatgctggaaacagc

SEQ ID NO: 58564 - DNA, 70 bp, Artificial Sequence
  Synthetic
gccaagcatttaggtgacactatagaaatccaccgaatgaaagaagtttcagagctatgctggaaacagc

SEQ ID NO: 58565 - DNA, 70 bp, Artificial Sequence
  Synthetic
gccaagcatttaggtgacactatagcataccgttctttcattcgggtttcagagctatgctggaaacagc

SEQ ID NO: 58566 - DNA, 70 bp, Artificial Sequence
  Synthetic
gccaagcatttaggtgacactatagcatggaccccattcagtagtgtttcagagctatgctggaaacagc

SEQ ID NO: 58567 - DNA, 70 bp, Artificial Sequence
  Synthetic
gccaagcatttaggtgacactataggttgtcaccatggatattaggtttcagagctatgctggaaacagc

SEQ ID NO: 58568 - DNA, 70 bp, Artificial Sequence
  Synthetic
gccaagcatttaggtgacactatagcagaggtggggaggctctctgtttcagagctatgctggaaacagc

SEQ ID NO: 58569 - DNA, 70 bp, Artificial Sequence
  Synthetic
gccaagcatttaggtgacactatagcttgcaatggaagatgtcaggtttcagagctatgctggaaacagc

SEQ ID NO: 58570 - DNA, 70 bp, Artificial Sequence
  Synthetic
gccaagcatttaggtgacactatagctcgagtcctccaagatctggtttcagagctatgctggaaacagc

SEQ ID NO: 58571 - DNA, 70 bp, Artificial Sequence
  Synthetic
gccaagcatttaggtgacactatagacacactgtatgctaagactgtttcagagctatgctggaaacagc

SEQ ID NO: 58572 - DNA, 70 bp, Artificial Sequence
  Synthetic
gccaagcatttaggtgacactataggggatggggcaggctctagggtttcagagctatgctggaaacagc

SEQ ID NO: 58573 - DNA, 70 bp, Artificial Sequence
  Synthetic
gccaagcatttaggtgacactatagcttaagcatgctctaggagggtttcagagctatgctggaaacagc

SEQ ID NO: 58574 - DNA, 70 bp, Artificial Sequence
  Synthetic
gccaagcatttaggtgacactatagttctgcagaagctgaagaacgtttcagagctatgctggaaacagc

SEQ ID NO: 58575 - DNA, 70 bp, Artificial Sequence
  Synthetic
gccaagcatttaggtgacactataggtatggttcagtgccacattgtttcagagctatgctggaaacagc

SEQ ID NO: 58576 - DNA, 70 bp, Artificial Sequence
  Synthetic
gccaagcatttaggtgacactatagtggacagtattctttggcttgtttcagagctatgctggaaacagc

SEQ ID NO: 58577 - DNA, 70 bp, Artificial Sequence
  Synthetic
gccaagcatttaggtgacactatagttacctttgactcttgtcccgtttcagagctatgctggaaacagc

SEQ ID NO: 58578 - DNA, 70 bp, Artificial Sequence
  Synthetic
gccaagcatttaggtgacactatagcagggttattcaatgtcttcgtttcagagctatgctggaaacagc

SEQ ID NO: 58579 - DNA, 70 bp, Artificial Sequence
  Synthetic
gccaagcatttaggtgacactatagggatttcttctcagtatcccgtttcagagctatgctggaaacagc

SEQ ID NO: 58580 - DNA, 70 bp, Artificial Sequence
  Synthetic
gccaagcatttaggtgacactataggcactcacttctggaaatgggtttcagagctatgctggaaacagc

SEQ ID NO: 58581 - DNA, 70 bp, Artificial Sequence
  Synthetic
gccaagcatttaggtgacactatagatgcactgcgacttaaactggtttcagagctatgctggaaacagc

SEQ ID NO: 58582 - DNA, 70 bp, Artificial Sequence
  Synthetic
gccaagcatttaggtgacactatagtctcaaacaagtttcacaacgtttcagagctatgctggaaacagc

SEQ ID NO: 58583 - DNA, 70 bp, Artificial Sequence
  Synthetic
gccaagcatttaggtgacactatagcgccatcgtggtcagagatagtttcagagctatgctggaaacagc

SEQ ID NO: 58584 - DNA, 70 bp, Artificial Sequence
  Synthetic
gccaagcatttaggtgacactatagaagtggctctgagagttcaggtttcagagctatgctggaaacagc

SEQ ID NO: 58585 - DNA, 70 bp, Artificial Sequence
  Synthetic
gccaagcatttaggtgacactatagacatctgcattctgaccagagtttcagagctatgctggaaacagc

SEQ ID NO: 58586 - DNA, 70 bp, Artificial Sequence
  Synthetic
gccaagcatttaggtgacactataggaacaagggggcgcaataaagtttcagagctatgctggaaacagc

SEQ ID NO: 58587 - DNA, 70 bp, Artificial Sequence
  Synthetic
gccaagcatttaggtgacactataggctgcccagccgacatcacagtttcagagctatgctggaaacagc

SEQ ID NO: 58588 - DNA, 70 bp, Artificial Sequence
  Synthetic
gccaagcatttaggtgacactatagtcctcagcaggtcagctgaagtttcagagctatgctggaaacagc

SEQ ID NO: 58589 - DNA, 70 bp, Artificial Sequence
  Synthetic
gccaagcatttaggtgacactatagacaagcaaacctcagcctgggtttcagagctatgctggaaacagc

SEQ ID NO: 58590 - DNA, 70 bp, Artificial Sequence
  Synthetic
gccaagcatttaggtgacactatagctgctgacttactttctactgtttcagagctatgctggaaacagc

SEQ ID NO: 58591 - DNA, 70 bp, Artificial Sequence
  Synthetic
gccaagcatttaggtgacactatagtttacaattcaagcagcagcgtttcagagctatgctggaaacagc

SEQ ID NO: 58592 - DNA, 70 bp, Artificial Sequence
  Synthetic
gccaagcatttaggtgacactatagagaaagagggctggggtcaggtttcagagctatgctggaaacagc

SEQ ID NO: 58593 - DNA, 70 bp, Artificial Sequence
  Synthetic
gccaagcatttaggtgacactatagtgttcaagagtgtcttggatgtttcagagctatgctggaaacagc

SEQ ID NO: 58594 - DNA, 70 bp, Artificial Sequence
  Synthetic
gccaagcatttaggtgacactatagcacagctatcttgaatcttcgtttcagagctatgctggaaacagc

SEQ ID NO: 58595 - DNA, 70 bp, Artificial Sequence
  Synthetic
gccaagcatttaggtgacactatagctgaggccagccggcagtgagtttcagagctatgctggaaacagc

SEQ ID NO: 58596 - DNA, 70 bp, Artificial Sequence
  Synthetic
gccaagcatttaggtgacactatagcatcttttaaaggctctccggtttcagagctatgctggaaacagc

SEQ ID NO: 58597 - DNA, 70 bp, Artificial Sequence
  Synthetic
gccaagcatttaggtgacactataggctatctcttgctgctcctcgtttcagagctatgctggaaacagc

SEQ ID NO: 58598 - DNA, 70 bp, Artificial Sequence
  Synthetic
gccaagcatttaggtgacactatagcagagggagtcaaggaacaagtttcagagctatgctggaaacagc

SEQ ID NO: 58599 - DNA, 70 bp, Artificial Sequence
  Synthetic
gccaagcatttaggtgacactatagtactgttgttcttcagggctgtttcagagctatgctggaaacagc

SEQ ID NO: 58600 - DNA, 70 bp, Artificial Sequence
  Synthetic
gccaagcatttaggtgacactatagtactgttgttcttcagagctgtttcagagctatgctggaaacagc

SEQ ID NO: 58601 - DNA, 70 bp, Artificial Sequence
  Synthetic
gccaagcatttaggtgacactataggcttccggtcagtggctacagtttcagagctatgctggaaacagc

SEQ ID NO: 58602 - DNA, 70 bp, Artificial Sequence
  Synthetic
gccaagcatttaggtgacactataggaggctgggcgggttactgcgtttcagagctatgctggaaacagc

SEQ ID NO: 58603 - DNA, 70 bp, Artificial Sequence
  Synthetic
gccaagcatttaggtgacactatagctatgcagggaccttgtaaggtttcagagctatgctggaaacagc

SEQ ID NO: 58604 - DNA, 70 bp, Artificial Sequence
  Synthetic
gccaagcatttaggtgacactatagggaggaggaggaggagggctgtttcagagctatgctggaaacagc

SEQ ID NO: 58605 - DNA, 70 bp, Artificial Sequence
  Synthetic
gccaagcatttaggtgacactatagctgtgcttcttgaacagtgagtttcagagctatgctggaaacagc

SEQ ID NO: 58606 - DNA, 70 bp, Artificial Sequence
  Synthetic
gccaagcatttaggtgacactatagtccctggacggcgtggactggtttcagagctatgctggaaacagc

SEQ ID NO: 58607 - DNA, 70 bp, Artificial Sequence
  Synthetic
gccaagcatttaggtgacactataggtgcttgcttactctacaacgtttcagagctatgctggaaacagc

SEQ ID NO: 58608 - DNA, 70 bp, Artificial Sequence
  Synthetic
gccaagcatttaggtgacactatagagtgagtcacacaaacttttgtttcagagctatgctggaaacagc

SEQ ID NO: 58609 - DNA, 70 bp, Artificial Sequence
  Synthetic
gccaagcatttaggtgacactatagtgcatagtcacctaatagtagtttcagagctatgctggaaacagc

SEQ ID NO: 58610 - DNA, 70 bp, Artificial Sequence
  Synthetic
gccaagcatttaggtgacactatagctggagatgtcccagcagtggtttcagagctatgctggaaacagc

SEQ ID NO: 58611 - DNA, 70 bp, Artificial Sequence
  Synthetic
gccaagcatttaggtgacactatagttcctacaccttttcctagggtttcagagctatgctggaaacagc

SEQ ID NO: 58612 - DNA, 70 bp, Artificial Sequence
  Synthetic
gccaagcatttaggtgacactataggcgaatctatcaccaagagcgtttcagagctatgctggaaacagc

SEQ ID NO: 58613 - DNA, 70 bp, Artificial Sequence
  Synthetic
gccaagcatttaggtgacactatagcttgaggcttcagtccttgagtttcagagctatgctggaaacagc

SEQ ID NO: 58614 - DNA, 70 bp, Artificial Sequence
  Synthetic
gccaagcatttaggtgacactatagcatggtgagggtcagctgccgtttcagagctatgctggaaacagc

SEQ ID NO: 58615 - DNA, 70 bp, Artificial Sequence
  Synthetic
gccaagcatttaggtgacactatagggcctgacccctgccctcacgtttcagagctatgctggaaacagc

SEQ ID NO: 58616 - DNA, 70 bp, Artificial Sequence
  Synthetic
gccaagcatttaggtgacactatagttctgaatgattggagagaagtttcagagctatgctggaaacagc

SEQ ID NO: 58617 - DNA, 70 bp, Artificial Sequence
  Synthetic
gccaagcatttaggtgacactatagtgaccttctggatatttagggtttcagagctatgctggaaacagc

SEQ ID NO: 58618 - DNA, 70 bp, Artificial Sequence
  Synthetic
gccaagcatttaggtgacactatagactggaagcagcacatcattgtttcagagctatgctggaaacagc

SEQ ID NO: 58619 - DNA, 70 bp, Artificial Sequence
  Synthetic
gccaagcatttaggtgacactatagactcatcttcacacgtcttcgtttcagagctatgctggaaacagc

SEQ ID NO: 58620 - DNA, 70 bp, Artificial Sequence
  Synthetic
gccaagcatttaggtgacactatagtaggaagatcacttgagggcgtttcagagctatgctggaaacagc

SEQ ID NO: 58621 - DNA, 70 bp, Artificial Sequence
  Synthetic
gccaagcatttaggtgacactatagctggcaagaagctgcgctgagtttcagagctatgctggaaacagc

SEQ ID NO: 58622 - DNA, 70 bp, Artificial Sequence
  Synthetic
gccaagcatttaggtgacactataggcgcaactcggccggacgcagtttcagagctatgctggaaacagc

SEQ ID NO: 58623 - DNA, 70 bp, Artificial Sequence
  Synthetic
gccaagcatttaggtgacactatagtccctccatgtccacctagggtttcagagctatgctggaaacagc

SEQ ID NO: 58624 - DNA, 70 bp, Artificial Sequence
  Synthetic
gccaagcatttaggtgacactataggcccttttatgtgctttaaggtttcagagctatgctggaaacagc

SEQ ID NO: 58625 - DNA, 70 bp, Artificial Sequence
  Synthetic
gccaagcatttaggtgacactatagtgacaccatcatggaagaatgtttcagagctatgctggaaacagc

SEQ ID NO: 58626 - DNA, 70 bp, Artificial Sequence
  Synthetic
gccaagcatttaggtgacactatagatagttactgcagccaacgtgtttcagagctatgctggaaacagc

SEQ ID NO: 58627 - DNA, 70 bp, Artificial Sequence
  Synthetic
gccaagcatttaggtgacactatagcactgctgcttgcactctgcgtttcagagctatgctggaaacagc

SEQ ID NO: 58628 - DNA, 70 bp, Artificial Sequence
  Synthetic
gccaagcatttaggtgacactatagtgtcttctactaatgcctcagtttcagagctatgctggaaacagc

SEQ ID NO: 58629 - DNA, 70 bp, Artificial Sequence
  Synthetic
gccaagcatttaggtgacactatagtactatactggagaagtcaagtttcagagctatgctggaaacagc

SEQ ID NO: 58630 - DNA, 70 bp, Artificial Sequence
  Synthetic
gccaagcatttaggtgacactatagtgatgcggaaattaaccccagtttcagagctatgctggaaacagc

SEQ ID NO: 58631 - DNA, 70 bp, Artificial Sequence
  Synthetic
gccaagcatttaggtgacactataggatgacgccaagaagtaagggtttcagagctatgctggaaacagc

SEQ ID NO: 58632 - DNA, 70 bp, Artificial Sequence
  Synthetic
gccaagcatttaggtgacactatagggctgggtggggcttagcgcgtttcagagctatgctggaaacagc

SEQ ID NO: 58633 - DNA, 70 bp, Artificial Sequence
  Synthetic
gccaagcatttaggtgacactatagcaaggggatggagaaggagagtttcagagctatgctggaaacagc

SEQ ID NO: 58634 - DNA, 70 bp, Artificial Sequence
  Synthetic
gccaagcatttaggtgacactatagaatgaagctctagagagatagtttcagagctatgctggaaacagc

SEQ ID NO: 58635 - DNA, 70 bp, Artificial Sequence
  Synthetic
gccaagcatttaggtgacactataggaggaagatgaatactcagggtttcagagctatgctggaaacagc

SEQ ID NO: 58636 - DNA, 70 bp, Artificial Sequence
  Synthetic
gccaagcatttaggtgacactatagagccccgctccgagtctcaggtttcagagctatgctggaaacagc

SEQ ID NO: 58637 - DNA, 70 bp, Artificial Sequence
  Synthetic
gccaagcatttaggtgacactatagcgcttcacttgggcgtcaccgtttcagagctatgctggaaacagc

SEQ ID NO: 58638 - DNA, 70 bp, Artificial Sequence
  Synthetic
gccaagcatttaggtgacactatagcacacagcctggacatcaaggtttcagagctatgctggaaacagc

SEQ ID NO: 58639 - DNA, 70 bp, Artificial Sequence
  Synthetic
gccaagcatttaggtgacactataggcctgggcatccggtggtaggtttcagagctatgctggaaacagc

SEQ ID NO: 58640 - DNA, 70 bp, Artificial Sequence
  Synthetic
gccaagcatttaggtgacactatagatggttatggcgtgcaacgcgtttcagagctatgctggaaacagc

SEQ ID NO: 58641 - DNA, 70 bp, Artificial Sequence
  Synthetic
gccaagcatttaggtgacactatagtcattcatgccttttatagcgtttcagagctatgctggaaacagc

SEQ ID NO: 58642 - DNA, 70 bp, Artificial Sequence
  Synthetic
gccaagcatttaggtgacactataggaaagcactgcatgttaagagtttcagagctatgctggaaacagc

SEQ ID NO: 58643 - DNA, 70 bp, Artificial Sequence
  Synthetic
gccaagcatttaggtgacactatagagaaagcttgtgcccaaacagtttcagagctatgctggaaacagc

SEQ ID NO: 58644 - DNA, 70 bp, Artificial Sequence
  Synthetic
gccaagcatttaggtgacactatagcttcaacttcttgctctgttgtttcagagctatgctggaaacagc

SEQ ID NO: 58645 - DNA, 70 bp, Artificial Sequence
  Synthetic
gccaagcatttaggtgacactatagctgtcagtctgtagcttcacgtttcagagctatgctggaaacagc

SEQ ID NO: 58646 - DNA, 70 bp, Artificial Sequence
  Synthetic
gccaagcatttaggtgacactatagctgctggaggccgacatctggtttcagagctatgctggaaacagc

SEQ ID NO: 58647 - DNA, 70 bp, Artificial Sequence
  Synthetic
gccaagcatttaggtgacactatagatagtaagggatccatcaccgtttcagagctatgctggaaacagc

SEQ ID NO: 58648 - DNA, 70 bp, Artificial Sequence
  Synthetic
gccaagcatttaggtgacactatagtggatggaaaaagacatctggtttcagagctatgctggaaacagc

SEQ ID NO: 58649 - DNA, 70 bp, Artificial Sequence
  Synthetic
gccaagcatttaggtgacactatagacctcccttcttctaaggtagtttcagagctatgctggaaacagc

SEQ ID NO: 58650 - DNA, 70 bp, Artificial Sequence
  Synthetic
gccaagcatttaggtgacactatagacctcccttctgctcaggcagtttcagagctatgctggaaacagc

SEQ ID NO: 58651 - DNA, 70 bp, Artificial Sequence
  Synthetic
gccaagcatttaggtgacactatagctaccgcctgcagctgcgcggtttcagagctatgctggaaacagc

SEQ ID NO: 58652 - DNA, 70 bp, Artificial Sequence
  Synthetic
gccaagcatttaggtgacactatagcacaaggcccagccatcagcgtttcagagctatgctggaaacagc

SEQ ID NO: 58653 - DNA, 70 bp, Artificial Sequence
  Synthetic
gccaagcatttaggtgacactataggctcgtggtagctcttcacagtttcagagctatgctggaaacagc

SEQ ID NO: 58654 - DNA, 70 bp, Artificial Sequence
  Synthetic
gccaagcatttaggtgacactataggagcatctgccacaggtcaagtttcagagctatgctggaaacagc

SEQ ID NO: 58655 - DNA, 70 bp, Artificial Sequence
  Synthetic
gccaagcatttaggtgacactatagaccttcaggcaacactttaagtttcagagctatgctggaaacagc

SEQ ID NO: 58656 - DNA, 70 bp, Artificial Sequence
  Synthetic
gccaagcatttaggtgacactatagttggagtccactctgtgacagtttcagagctatgctggaaacagc

SEQ ID NO: 58657 - DNA, 70 bp, Artificial Sequence
  Synthetic
gccaagcatttaggtgacactatagtaacttttttcaccctctaggtttcagagctatgctggaaacagc

SEQ ID NO: 58658 - DNA, 70 bp, Artificial Sequence
  Synthetic
gccaagcatttaggtgacactatagggtttcaaagagcttgctgagtttcagagctatgctggaaacagc

SEQ ID NO: 58659 - DNA, 70 bp, Artificial Sequence
  Synthetic
gccaagcatttaggtgacactataggtgtctatcgtctgcagtgagtttcagagctatgctggaaacagc

SEQ ID NO: 58660 - DNA, 70 bp, Artificial Sequence
  Synthetic
gccaagcatttaggtgacactatagcagcacagcactgggtgtgagtttcagagctatgctggaaacagc

SEQ ID NO: 58661 - DNA, 70 bp, Artificial Sequence
  Synthetic
gccaagcatttaggtgacactatagttatttctctacttctccgggtttcagagctatgctggaaacagc

SEQ ID NO: 58662 - DNA, 70 bp, Artificial Sequence
  Synthetic
gccaagcatttaggtgacactatagctgatcactggcatggcttcgtttcagagctatgctggaaacagc

SEQ ID NO: 58663 - DNA, 70 bp, Artificial Sequence
  Synthetic
gccaagcatttaggtgacactatagcggctcagccagatttcagcgtttcagagctatgctggaaacagc

SEQ ID NO: 58664 - DNA, 70 bp, Artificial Sequence
  Synthetic
gccaagcatttaggtgacactatagcaggttcagcgcgcctcagtgtttcagagctatgctggaaacagc

SEQ ID NO: 58665 - DNA, 70 bp, Artificial Sequence
  Synthetic
gccaagcatttaggtgacactataggaagagggggctgaggactggtttcagagctatgctggaaacagc

SEQ ID NO: 58666 - DNA, 70 bp, Artificial Sequence
  Synthetic
gccaagcatttaggtgacactatagcagaactagaagagtggctagtttcagagctatgctggaaacagc

SEQ ID NO: 58667 - DNA, 70 bp, Artificial Sequence
  Synthetic
gccaagcatttaggtgacactatagttagtaagggctgcttactggtttcagagctatgctggaaacagc

SEQ ID NO: 58668 - DNA, 70 bp, Artificial Sequence
  Synthetic
gccaagcatttaggtgacactatagctccacctggtgttccagatgtttcagagctatgctggaaacagc

SEQ ID NO: 58669 - DNA, 70 bp, Artificial Sequence
  Synthetic
gccaagcatttaggtgacactatagcaggctcagcagcgtgctgagtttcagagctatgctggaaacagc

SEQ ID NO: 58670 - DNA, 70 bp, Artificial Sequence
  Synthetic
gccaagcatttaggtgacactatagttactaagggctgcttattggtttcagagctatgctggaaacagc

SEQ ID NO: 58671 - DNA, 70 bp, Artificial Sequence
  Synthetic
gccaagcatttaggtgacactatagttagtaagagctgcttattggtttcagagctatgctggaaacagc

SEQ ID NO: 58672 - DNA, 70 bp, Artificial Sequence
  Synthetic
gccaagcatttaggtgacactatagttagtaagggctgcctattggtttcagagctatgctggaaacagc

SEQ ID NO: 58673 - DNA, 70 bp, Artificial Sequence
  Synthetic
gccaagcatttaggtgacactatagttagtaagggctgtttattggtttcagagctatgctggaaacagc

SEQ ID NO: 58674 - DNA, 70 bp, Artificial Sequence
  Synthetic
gccaagcatttaggtgacactatagttagtaagggctgcttagtggtttcagagctatgctggaaacagc

SEQ ID NO: 58675 - DNA, 70 bp, Artificial Sequence
  Synthetic
gccaagcatttaggtgacactatagggaaggacgcaaaggatggcgtttcagagctatgctggaaacagc

SEQ ID NO: 58676 - DNA, 70 bp, Artificial Sequence
  Synthetic
gccaagcatttaggtgacactataggaaaggatgcaaaggatgatgtttcagagctatgctggaaacagc

SEQ ID NO: 58677 - DNA, 70 bp, Artificial Sequence
  Synthetic
gccaagcatttaggtgacactatagactgcagggctccttcactggtttcagagctatgctggaaacagc

SEQ ID NO: 58678 - DNA, 70 bp, Artificial Sequence
  Synthetic
gccaagcatttaggtgacactatagttagtaagggctgcttattggtttcagagctatgctggaaacagc

SEQ ID NO: 58679 - DNA, 70 bp, Artificial Sequence
  Synthetic
gccaagcatttaggtgacactatagaatgaactgtacttagaaccgtttcagagctatgctggaaacagc

SEQ ID NO: 58680 - DNA, 70 bp, Artificial Sequence
  Synthetic
gccaagcatttaggtgacactatagtcagtccctgatcagatcaggtttcagagctatgctggaaacagc

SEQ ID NO: 58681 - DNA, 70 bp, Artificial Sequence
  Synthetic
gccaagcatttaggtgacactatagtggtacagccaacgctattggtttcagagctatgctggaaacagc

SEQ ID NO: 58682 - DNA, 70 bp, Artificial Sequence
  Synthetic
gccaagcatttaggtgacactataggtgggcgcagggctcagaacgtttcagagctatgctggaaacagc

SEQ ID NO: 58683 - DNA, 70 bp, Artificial Sequence
  Synthetic
gccaagcatttaggtgacactataggaacgagagcaaagcatgatgtttcagagctatgctggaaacagc

SEQ ID NO: 58684 - DNA, 70 bp, Artificial Sequence
  Synthetic
gccaagcatttaggtgacactataggactcttcttttgctctgttgtttcagagctatgctggaaacagc

SEQ ID NO: 58685 - DNA, 70 bp, Artificial Sequence
  Synthetic
gccaagcatttaggtgacactataggtggtggagaaagaatgactgtttcagagctatgctggaaacagc

SEQ ID NO: 58686 - DNA, 70 bp, Artificial Sequence
  Synthetic
gccaagcatttaggtgacactatagaaacacgcaagacaaacttagtttcagagctatgctggaaacagc

SEQ ID NO: 58687 - DNA, 70 bp, Artificial Sequence
  Synthetic
gccaagcatttaggtgacactatagaagctgcaagcagaattggagtttcagagctatgctggaaacagc

SEQ ID NO: 58688 - DNA, 70 bp, Artificial Sequence
  Synthetic
gccaagcatttaggtgacactatagtgcctttaaaggaagaagatgtttcagagctatgctggaaacagc

SEQ ID NO: 58689 - DNA, 70 bp, Artificial Sequence
  Synthetic
gccaagcatttaggtgacactatagttgactcactttgaactccagtttcagagctatgctggaaacagc

SEQ ID NO: 58690 - DNA, 70 bp, Artificial Sequence
  Synthetic
gccaagcatttaggtgacactatagaggactgggagaaggacgaagtttcagagctatgctggaaacagc

SEQ ID NO: 58691 - DNA, 70 bp, Artificial Sequence
  Synthetic
gccaagcatttaggtgacactatagggctcgcaggcacagatcctgtttcagagctatgctggaaacagc

SEQ ID NO: 58692 - DNA, 70 bp, Artificial Sequence
  Synthetic
gccaagcatttaggtgacactatagggtgggaggcgctgtttagtgtttcagagctatgctggaaacagc

SEQ ID NO: 58693 - DNA, 70 bp, Artificial Sequence
  Synthetic
gccaagcatttaggtgacactatagcttcattgagaaattgggcagtttcagagctatgctggaaacagc

SEQ ID NO: 58694 - DNA, 70 bp, Artificial Sequence
  Synthetic
gccaagcatttaggtgacactatagtgaatcatcatcaagaactcgtttcagagctatgctggaaacagc

SEQ ID NO: 58695 - DNA, 70 bp, Artificial Sequence
  Synthetic
gccaagcatttaggtgacactatagtgcctcagtcccaattggctgtttcagagctatgctggaaacagc

SEQ ID NO: 58696 - DNA, 70 bp, Artificial Sequence
  Synthetic
gccaagcatttaggtgacactatagtctgatgttcttgtgaggcagtttcagagctatgctggaaacagc

SEQ ID NO: 58697 - DNA, 70 bp, Artificial Sequence
  Synthetic
gccaagcatttaggtgacactataggcagaacctgagctgtgaacgtttcagagctatgctggaaacagc

SEQ ID NO: 58698 - DNA, 70 bp, Artificial Sequence
  Synthetic
gccaagcatttaggtgacactatagtccatggcccagccctgagtgtttcagagctatgctggaaacagc

SEQ ID NO: 58699 - DNA, 70 bp, Artificial Sequence
  Synthetic
gccaagcatttaggtgacactatagtctgtgccctgcaggcctaagtttcagagctatgctggaaacagc

SEQ ID NO: 58700 - DNA, 70 bp, Artificial Sequence
  Synthetic
gccaagcatttaggtgacactatagacagagctctcaccactcacgtttcagagctatgctggaaacagc

SEQ ID NO: 58701 - DNA, 70 bp, Artificial Sequence
  Synthetic
gccaagcatttaggtgacactatagcattctggtagaggaggcttgtttcagagctatgctggaaacagc

SEQ ID NO: 58702 - DNA, 70 bp, Artificial Sequence
  Synthetic
gccaagcatttaggtgacactatagggaaagcagctctggttcaggtttcagagctatgctggaaacagc

SEQ ID NO: 58703 - DNA, 70 bp, Artificial Sequence
  Synthetic
gccaagcatttaggtgacactatagtgtgcagctccgggagtgacgtttcagagctatgctggaaacagc

SEQ ID NO: 58704 - DNA, 70 bp, Artificial Sequence
  Synthetic
gccaagcatttaggtgacactataggtgcctgtcagagccctgaggtttcagagctatgctggaaacagc

SEQ ID NO: 58705 - DNA, 70 bp, Artificial Sequence
  Synthetic
gccaagcatttaggtgacactatagtggaagttttgctcctttacgtttcagagctatgctggaaacagc

SEQ ID NO: 58706 - DNA, 70 bp, Artificial Sequence
  Synthetic
gccaagcatttaggtgacactataggactgcgctccagcctcagagtttcagagctatgctggaaacagc

SEQ ID NO: 58707 - DNA, 70 bp, Artificial Sequence
  Synthetic
gccaagcatttaggtgacactatagaagcactcggagagaagtctgtttcagagctatgctggaaacagc

SEQ ID NO: 58708 - DNA, 70 bp, Artificial Sequence
  Synthetic
gccaagcatttaggtgacactataggctccagcaggtctttcaatgtttcagagctatgctggaaacagc

SEQ ID NO: 58709 - DNA, 70 bp, Artificial Sequence
  Synthetic
gccaagcatttaggtgacactatagcacgcagaaggacaactacagtttcagagctatgctggaaacagc

SEQ ID NO: 58710 - DNA, 70 bp, Artificial Sequence
  Synthetic
gccaagcatttaggtgacactatagatgttctacaagttcttccagtttcagagctatgctggaaacagc

SEQ ID NO: 58711 - DNA, 70 bp, Artificial Sequence
  Synthetic
gccaagcatttaggtgacactatagtcgtcagggccctgcagtgagtttcagagctatgctggaaacagc

SEQ ID NO: 58712 - DNA, 70 bp, Artificial Sequence
  Synthetic
gccaagcatttaggtgacactatagacccggccggccagctttaggtttcagagctatgctggaaacagc

SEQ ID NO: 58713 - DNA, 70 bp, Artificial Sequence
  Synthetic
gccaagcatttaggtgacactatagcactttgtttgtagacagcagtttcagagctatgctggaaacagc

SEQ ID NO: 58714 - DNA, 70 bp, Artificial Sequence
  Synthetic
gccaagcatttaggtgacactatagtactggcaggcattcagtttgtttcagagctatgctggaaacagc

SEQ ID NO: 58715 - DNA, 70 bp, Artificial Sequence
  Synthetic
gccaagcatttaggtgacactatagaatggttttggagctggaaggtttcagagctatgctggaaacagc

SEQ ID NO: 58716 - DNA, 70 bp, Artificial Sequence
  Synthetic
gccaagcatttaggtgacactatagttgtgggagtcagggctgaggtttcagagctatgctggaaacagc

SEQ ID NO: 58717 - DNA, 70 bp, Artificial Sequence
  Synthetic
gccaagcatttaggtgacactataggaggacagcaaggtgctagcgtttcagagctatgctggaaacagc

SEQ ID NO: 58718 - DNA, 70 bp, Artificial Sequence
  Synthetic
gccaagcatttaggtgacactatagaacttcgtcttctttccttggtttcagagctatgctggaaacagc

SEQ ID NO: 58719 - DNA, 70 bp, Artificial Sequence
  Synthetic
gccaagcatttaggtgacactataggtggctgtgtcactgtgtctgtttcagagctatgctggaaacagc

SEQ ID NO: 58720 - DNA, 70 bp, Artificial Sequence
  Synthetic
gccaagcatttaggtgacactataggaggtcatcgcgtctccaccgtttcagagctatgctggaaacagc

SEQ ID NO: 58721 - DNA, 70 bp, Artificial Sequence
  Synthetic
gccaagcatttaggtgacactatagattcagtcagtagctgctgagtttcagagctatgctggaaacagc

SEQ ID NO: 58722 - DNA, 70 bp, Artificial Sequence
  Synthetic
gccaagcatttaggtgacactatagctgtggtgactacagactaggtttcagagctatgctggaaacagc

SEQ ID NO: 58723 - DNA, 70 bp, Artificial Sequence
  Synthetic
gccaagcatttaggtgacactatagagcaggagggagacacaacagtttcagagctatgctggaaacagc

SEQ ID NO: 58724 - DNA, 70 bp, Artificial Sequence
  Synthetic
gccaagcatttaggtgacactatagcccatgtctggcatgcctatgtttcagagctatgctggaaacagc

SEQ ID NO: 58725 - DNA, 70 bp, Artificial Sequence
  Synthetic
gccaagcatttaggtgacactatagatcaactttaagctgcatacgtttcagagctatgctggaaacagc

SEQ ID NO: 58726 - DNA, 70 bp, Artificial Sequence
  Synthetic
gccaagcatttaggtgacactataggggaattttcagatcccatggtttcagagctatgctggaaacagc

SEQ ID NO: 58727 - DNA, 70 bp, Artificial Sequence
  Synthetic
gccaagcatttaggtgacactataggcttggctgtgtcttcagcggtttcagagctatgctggaaacagc

SEQ ID NO: 58728 - DNA, 70 bp, Artificial Sequence
  Synthetic
gccaagcatttaggtgacactatagtttagcttcagtaatgcctcgtttcagagctatgctggaaacagc

SEQ ID NO: 58729 - DNA, 70 bp, Artificial Sequence
  Synthetic
gccaagcatttaggtgacactatagcgcagtcctgcttgtttactgtttcagagctatgctggaaacagc

SEQ ID NO: 58730 - DNA, 70 bp, Artificial Sequence
  Synthetic
gccaagcatttaggtgacactatagagttcaggatctggaggtgtgtttcagagctatgctggaaacagc

SEQ ID NO: 58731 - DNA, 70 bp, Artificial Sequence
  Synthetic
gccaagcatttaggtgacactatagcaaacagagagtgggaaggtgtttcagagctatgctggaaacagc

SEQ ID NO: 58732 - DNA, 70 bp, Artificial Sequence
  Synthetic
gccaagcatttaggtgacactatagttcagtcatcactatccgacgtttcagagctatgctggaaacagc

SEQ ID NO: 58733 - DNA, 70 bp, Artificial Sequence
  Synthetic
gccaagcatttaggtgacactatagtgttctgagtcactcgctgtgtttcagagctatgctggaaacagc

SEQ ID NO: 58734 - DNA, 70 bp, Artificial Sequence
  Synthetic
gccaagcatttaggtgacactatagccacttgggaaggcaggagagtttcagagctatgctggaaacagc

SEQ ID NO: 58735 - DNA, 70 bp, Artificial Sequence
  Synthetic
gccaagcatttaggtgacactatagcatatggtggaaaaccatgagtttcagagctatgctggaaacagc

SEQ ID NO: 58736 - DNA, 70 bp, Artificial Sequence
  Synthetic
gccaagcatttaggtgacactatagtatttctctctctacaggtggtttcagagctatgctggaaacagc

SEQ ID NO: 58737 - DNA, 70 bp, Artificial Sequence
  Synthetic
gccaagcatttaggtgacactatagtggaagggaaagttcagagtgtttcagagctatgctggaaacagc

SEQ ID NO: 58738 - DNA, 70 bp, Artificial Sequence
  Synthetic
gccaagcatttaggtgacactataggacaatcaggctcagcctccgtttcagagctatgctggaaacagc

SEQ ID NO: 58739 - DNA, 70 bp, Artificial Sequence
  Synthetic
gccaagcatttaggtgacactatagtgaagaggactagggacatcgtttcagagctatgctggaaacagc

SEQ ID NO: 58740 - DNA, 70 bp, Artificial Sequence
  Synthetic
gccaagcatttaggtgacactataggtccatcaggcatttactgtgtttcagagctatgctggaaacagc

SEQ ID NO: 58741 - DNA, 70 bp, Artificial Sequence
  Synthetic
gccaagcatttaggtgacactataggctgtccctctacgacgggcgtttcagagctatgctggaaacagc

SEQ ID NO: 58742 - DNA, 70 bp, Artificial Sequence
  Synthetic
gccaagcatttaggtgacactatagggagctgtgtcatactgagggtttcagagctatgctggaaacagc

SEQ ID NO: 58743 - DNA, 70 bp, Artificial Sequence
  Synthetic
gccaagcatttaggtgacactatagccggatttcaggaagccttggtttcagagctatgctggaaacagc

SEQ ID NO: 58744 - DNA, 70 bp, Artificial Sequence
  Synthetic
gccaagcatttaggtgacactatagatgcatgtcagaagatctctgtttcagagctatgctggaaacagc

SEQ ID NO: 58745 - DNA, 70 bp, Artificial Sequence
  Synthetic
gccaagcatttaggtgacactataggaccaagaacaggcttcagcgtttcagagctatgctggaaacagc

SEQ ID NO: 58746 - DNA, 70 bp, Artificial Sequence
  Synthetic
gccaagcatttaggtgacactatagatatttcccacgttgttcatgtttcagagctatgctggaaacagc

SEQ ID NO: 58747 - DNA, 70 bp, Artificial Sequence
  Synthetic
gccaagcatttaggtgacactatagctaggcactcacacactgaggtttcagagctatgctggaaacagc

SEQ ID NO: 58748 - DNA, 70 bp, Artificial Sequence
  Synthetic
gccaagcatttaggtgacactatagggatctcttacggaaagtaggtttcagagctatgctggaaacagc

SEQ ID NO: 58749 - DNA, 70 bp, Artificial Sequence
  Synthetic
gccaagcatttaggtgacactatagaataaagagaactctggtccgtttcagagctatgctggaaacagc

SEQ ID NO: 58750 - DNA, 70 bp, Artificial Sequence
  Synthetic
gccaagcatttaggtgacactatagtggcagctgctcatagaacagtttcagagctatgctggaaacagc

SEQ ID NO: 58751 - DNA, 70 bp, Artificial Sequence
  Synthetic
gccaagcatttaggtgacactatagccctcgcagcagtgtctctggtttcagagctatgctggaaacagc

SEQ ID NO: 58752 - DNA, 70 bp, Artificial Sequence
  Synthetic
gccaagcatttaggtgacactatagtttatgtcataggacatggggtttcagagctatgctggaaacagc

SEQ ID NO: 58753 - DNA, 70 bp, Artificial Sequence
  Synthetic
gccaagcatttaggtgacactatagcagacagagacgtgggcctggtttcagagctatgctggaaacagc

SEQ ID NO: 58754 - DNA, 70 bp, Artificial Sequence
  Synthetic
gccaagcatttaggtgacactataggtccatgccagcggacgtctgtttcagagctatgctggaaacagc

SEQ ID NO: 58755 - DNA, 70 bp, Artificial Sequence
  Synthetic
gccaagcatttaggtgacactatagtgcgaggaatgcaattcctggtttcagagctatgctggaaacagc

SEQ ID NO: 58756 - DNA, 70 bp, Artificial Sequence
  Synthetic
gccaagcatttaggtgacactatagcatggaggtctcctgctagggtttcagagctatgctggaaacagc

SEQ ID NO: 58757 - DNA, 70 bp, Artificial Sequence
  Synthetic
gccaagcatttaggtgacactatagcatggaggtctcctgttgaagtttcagagctatgctggaaacagc

SEQ ID NO: 58758 - DNA, 70 bp, Artificial Sequence
  Synthetic
gccaagcatttaggtgacactataggggaggagcatctgcttagcgtttcagagctatgctggaaacagc

SEQ ID NO: 58759 - DNA, 70 bp, Artificial Sequence
  Synthetic
gccaagcatttaggtgacactataggcgggatcaagggcttcaacgtttcagagctatgctggaaacagc

SEQ ID NO: 58760 - DNA, 70 bp, Artificial Sequence
  Synthetic
gccaagcatttaggtgacactatagctgtggtggccacggctaccgtttcagagctatgctggaaacagc

SEQ ID NO: 58761 - DNA, 70 bp, Artificial Sequence
  Synthetic
gccaagcatttaggtgacactataggctgggacatcagcccagacgtttcagagctatgctggaaacagc

SEQ ID NO: 58762 - DNA, 70 bp, Artificial Sequence
  Synthetic
gccaagcatttaggtgacactataggtaagactcgctgtctaggcgtttcagagctatgctggaaacagc

SEQ ID NO: 58763 - DNA, 70 bp, Artificial Sequence
  Synthetic
gccaagcatttaggtgacactatagtgggtcagcctctgccatccgtttcagagctatgctggaaacagc

SEQ ID NO: 58764 - DNA, 70 bp, Artificial Sequence
  Synthetic
gccaagcatttaggtgacactatagtctgccatcgtggctgagacgtttcagagctatgctggaaacagc

SEQ ID NO: 58765 - DNA, 70 bp, Artificial Sequence
  Synthetic
gccaagcatttaggtgacactatagtgatcgttactatgtgtcaagtttcagagctatgctggaaacagc

SEQ ID NO: 58766 - DNA, 70 bp, Artificial Sequence
  Synthetic
gccaagcatttaggtgacactatagaggtgggagacaagtggatcgtttcagagctatgctggaaacagc

SEQ ID NO: 58767 - DNA, 70 bp, Artificial Sequence
  Synthetic
gccaagcatttaggtgacactatagtcgtgtccaagatagttgctgtttcagagctatgctggaaacagc

SEQ ID NO: 58768 - DNA, 70 bp, Artificial Sequence
  Synthetic
gccaagcatttaggtgacactatagtggatctggctgaagtgaacgtttcagagctatgctggaaacagc

SEQ ID NO: 58769 - DNA, 70 bp, Artificial Sequence
  Synthetic
gccaagcatttaggtgacactatagtggaagagggctaagagatcgtttcagagctatgctggaaacagc

SEQ ID NO: 58770 - DNA, 70 bp, Artificial Sequence
  Synthetic
gccaagcatttaggtgacactatagcaggcacagggctcacacctgtttcagagctatgctggaaacagc

SEQ ID NO: 58771 - DNA, 70 bp, Artificial Sequence
  Synthetic
gccaagcatttaggtgacactatagttagtgggggaagacaaatagtttcagagctatgctggaaacagc

SEQ ID NO: 58772 - DNA, 70 bp, Artificial Sequence
  Synthetic
gccaagcatttaggtgacactatagtacttgtaaggtgttgaagggtttcagagctatgctggaaacagc

SEQ ID NO: 58773 - DNA, 70 bp, Artificial Sequence
  Synthetic
gccaagcatttaggtgacactatagcggcttcatgtggtacacgtgtttcagagctatgctggaaacagc

SEQ ID NO: 58774 - DNA, 70 bp, Artificial Sequence
  Synthetic
gccaagcatttaggtgacactataggccctggagaacgttctaaggtttcagagctatgctggaaacagc

SEQ ID NO: 58775 - DNA, 70 bp, Artificial Sequence
  Synthetic
gccaagcatttaggtgacactatagtctttaactattctgcacccgtttcagagctatgctggaaacagc

SEQ ID NO: 58776 - DNA, 70 bp, Artificial Sequence
  Synthetic
gccaagcatttaggtgacactatagacagtttcttcagccactccgtttcagagctatgctggaaacagc

SEQ ID NO: 58777 - DNA, 70 bp, Artificial Sequence
  Synthetic
gccaagcatttaggtgacactatagggattacagcaagctgaagagtttcagagctatgctggaaacagc

SEQ ID NO: 58778 - DNA, 70 bp, Artificial Sequence
  Synthetic
gccaagcatttaggtgacactatagccacgtcgcttggcactcaggtttcagagctatgctggaaacagc

SEQ ID NO: 58779 - DNA, 70 bp, Artificial Sequence
  Synthetic
gccaagcatttaggtgacactatagctcctgccgatcagtggaaagtttcagagctatgctggaaacagc

SEQ ID NO: 58780 - DNA, 70 bp, Artificial Sequence
  Synthetic
gccaagcatttaggtgacactatagctgaatgacttcatggatcggtttcagagctatgctggaaacagc

SEQ ID NO: 58781 - DNA, 70 bp, Artificial Sequence
  Synthetic
gccaagcatttaggtgacactatagccgtgagggtgcagtgtcacgtttcagagctatgctggaaacagc

SEQ ID NO: 58782 - DNA, 70 bp, Artificial Sequence
  Synthetic
gccaagcatttaggtgacactataggccacggacccatctttactgtttcagagctatgctggaaacagc

SEQ ID NO: 58783 - DNA, 70 bp, Artificial Sequence
  Synthetic
gccaagcatttaggtgacactatagtgacctgggagaactgtcaagtttcagagctatgctggaaacagc

SEQ ID NO: 58784 - DNA, 70 bp, Artificial Sequence
  Synthetic
gccaagcatttaggtgacactatagcaggaggcactaaatgttgagtttcagagctatgctggaaacagc

SEQ ID NO: 58785 - DNA, 70 bp, Artificial Sequence
  Synthetic
gccaagcatttaggtgacactatagatggccatggaagacgaattgtttcagagctatgctggaaacagc

SEQ ID NO: 58786 - DNA, 70 bp, Artificial Sequence
  Synthetic
gccaagcatttaggtgacactatagattctccagagcttaacccagtttcagagctatgctggaaacagc

SEQ ID NO: 58787 - DNA, 70 bp, Artificial Sequence
  Synthetic
gccaagcatttaggtgacactatagttgtggctcttgccatctcggtttcagagctatgctggaaacagc

SEQ ID NO: 58788 - DNA, 70 bp, Artificial Sequence
  Synthetic
gccaagcatttaggtgacactatagtggcggttcattgagcagctgtttcagagctatgctggaaacagc

SEQ ID NO: 58789 - DNA, 70 bp, Artificial Sequence
  Synthetic
gccaagcatttaggtgacactatagcgtattgctttcttgtcttcgtttcagagctatgctggaaacagc

SEQ ID NO: 58790 - DNA, 70 bp, Artificial Sequence
  Synthetic
gccaagcatttaggtgacactatagtattgtgattttttccccgggtttcagagctatgctggaaacagc

SEQ ID NO: 58791 - DNA, 70 bp, Artificial Sequence
  Synthetic
gccaagcatttaggtgacactatagtggctttaatactctgactggtttcagagctatgctggaaacagc

SEQ ID NO: 58792 - DNA, 70 bp, Artificial Sequence
  Synthetic
gccaagcatttaggtgacactatagtcttctgctgtaaagatggggtttcagagctatgctggaaacagc

SEQ ID NO: 58793 - DNA, 70 bp, Artificial Sequence
  Synthetic
gccaagcatttaggtgacactatagctgggtttagtgaacttgctgtttcagagctatgctggaaacagc

SEQ ID NO: 58794 - DNA, 70 bp, Artificial Sequence
  Synthetic
gccaagcatttaggtgacactatagctggagggaggctgttaggagtttcagagctatgctggaaacagc

SEQ ID NO: 58795 - DNA, 70 bp, Artificial Sequence
  Synthetic
gccaagcatttaggtgacactatagaaaaacaggatctaacaccggtttcagagctatgctggaaacagc

SEQ ID NO: 58796 - DNA, 70 bp, Artificial Sequence
  Synthetic
gccaagcatttaggtgacactatagtttgctttcccgttggttcagtttcagagctatgctggaaacagc

SEQ ID NO: 58797 - DNA, 70 bp, Artificial Sequence
  Synthetic
gccaagcatttaggtgacactatagtctagccagtctttacttccgtttcagagctatgctggaaacagc

SEQ ID NO: 58798 - DNA, 70 bp, Artificial Sequence
  Synthetic
gccaagcatttaggtgacactataggcacccacagctgcctcagggtttcagagctatgctggaaacagc

SEQ ID NO: 58799 - DNA, 70 bp, Artificial Sequence
  Synthetic
gccaagcatttaggtgacactataggcaactggtcactcatcctcgtttcagagctatgctggaaacagc

SEQ ID NO: 58800 - DNA, 70 bp, Artificial Sequence
  Synthetic
gccaagcatttaggtgacactatagctcctgatgatgaagactgagtttcagagctatgctggaaacagc

SEQ ID NO: 58801 - DNA, 70 bp, Artificial Sequence
  Synthetic
gccaagcatttaggtgacactatagtatctttattcagggactccgtttcagagctatgctggaaacagc

SEQ ID NO: 58802 - DNA, 70 bp, Artificial Sequence
  Synthetic
gccaagcatttaggtgacactatagattgccagacttaatatgaggtttcagagctatgctggaaacagc

SEQ ID NO: 58803 - DNA, 70 bp, Artificial Sequence
  Synthetic
gccaagcatttaggtgacactatagtgggagctctgtgtggatttgtttcagagctatgctggaaacagc

SEQ ID NO: 58804 - DNA, 70 bp, Artificial Sequence
  Synthetic
gccaagcatttaggtgacactatagatgtgagaggagatggacccgtttcagagctatgctggaaacagc

SEQ ID NO: 58805 - DNA, 70 bp, Artificial Sequence
  Synthetic
gccaagcatttaggtgacactatagtaattgtcaggagttgctttgtttcagagctatgctggaaacagc

SEQ ID NO: 58806 - DNA, 70 bp, Artificial Sequence
  Synthetic
gccaagcatttaggtgacactatagtcaggaaattctttcattgggtttcagagctatgctggaaacagc

SEQ ID NO: 58807 - DNA, 70 bp, Artificial Sequence
  Synthetic
gccaagcatttaggtgacactataggtggggggtgcaccccctacgtttcagagctatgctggaaacagc

SEQ ID NO: 58808 - DNA, 70 bp, Artificial Sequence
  Synthetic
gccaagcatttaggtgacactatagcctcttcctcactcagcccagtttcagagctatgctggaaacagc

SEQ ID NO: 58809 - DNA, 70 bp, Artificial Sequence
  Synthetic
gccaagcatttaggtgacactataggttcactatgagatctgagggtttcagagctatgctggaaacagc

SEQ ID NO: 58810 - DNA, 70 bp, Artificial Sequence
  Synthetic
gccaagcatttaggtgacactataggaggtctctctctttctacagtttcagagctatgctggaaacagc

SEQ ID NO: 58811 - DNA, 70 bp, Artificial Sequence
  Synthetic
gccaagcatttaggtgacactatagaacccaactttcagccagtcgtttcagagctatgctggaaacagc

SEQ ID NO: 58812 - DNA, 70 bp, Artificial Sequence
  Synthetic
gccaagcatttaggtgacactataggtacaaaagaagaaatgggcgtttcagagctatgctggaaacagc

SEQ ID NO: 58813 - DNA, 70 bp, Artificial Sequence
  Synthetic
gccaagcatttaggtgacactataggaagacttcaacgtattggagtttcagagctatgctggaaacagc

SEQ ID NO: 58814 - DNA, 70 bp, Artificial Sequence
  Synthetic
gccaagcatttaggtgacactatagtcgccagcttctatatattagtttcagagctatgctggaaacagc

SEQ ID NO: 58815 - DNA, 70 bp, Artificial Sequence
  Synthetic
gccaagcatttaggtgacactatagtgctcctgaggatcaccaccgtttcagagctatgctggaaacagc

SEQ ID NO: 58816 - DNA, 70 bp, Artificial Sequence
  Synthetic
gccaagcatttaggtgacactatagctagtagaagcttcagcatagtttcagagctatgctggaaacagc

SEQ ID NO: 58817 - DNA, 70 bp, Artificial Sequence
  Synthetic
gccaagcatttaggtgacactatagggagaagtagatcggtgagcgtttcagagctatgctggaaacagc

SEQ ID NO: 58818 - DNA, 70 bp, Artificial Sequence
  Synthetic
gccaagcatttaggtgacactatagggatacctctactacacaatgtttcagagctatgctggaaacagc

SEQ ID NO: 58819 - DNA, 70 bp, Artificial Sequence
  Synthetic
gccaagcatttaggtgacactatagatgcgttccctggagctactgtttcagagctatgctggaaacagc

SEQ ID NO: 58820 - DNA, 70 bp, Artificial Sequence
  Synthetic
gccaagcatttaggtgacactatagagagtatccacaaaataggtgtttcagagctatgctggaaacagc

SEQ ID NO: 58821 - DNA, 70 bp, Artificial Sequence
  Synthetic
gccaagcatttaggtgacactatagggaaaatcctttgatgggttgtttcagagctatgctggaaacagc

SEQ ID NO: 58822 - DNA, 70 bp, Artificial Sequence
  Synthetic
gccaagcatttaggtgacactatagagctgctctgttcagggccggtttcagagctatgctggaaacagc

SEQ ID NO: 58823 - DNA, 70 bp, Artificial Sequence
  Synthetic
gccaagcatttaggtgacactatagcggcgtgccacacgctctaggtttcagagctatgctggaaacagc

SEQ ID NO: 58824 - DNA, 70 bp, Artificial Sequence
  Synthetic
gccaagcatttaggtgacactatagggcggcggcggcgctacctggtttcagagctatgctggaaacagc

SEQ ID NO: 58825 - DNA, 70 bp, Artificial Sequence
  Synthetic
gccaagcatttaggtgacactatagtccaggctgactacttgtatgtttcagagctatgctggaaacagc

SEQ ID NO: 58826 - DNA, 70 bp, Artificial Sequence
  Synthetic
gccaagcatttaggtgacactatagggccagggtggtgggctaaggtttcagagctatgctggaaacagc

SEQ ID NO: 58827 - DNA, 70 bp, Artificial Sequence
  Synthetic
gccaagcatttaggtgacactatagcctggatttggtgtacaagcgtttcagagctatgctggaaacagc

SEQ ID NO: 58828 - DNA, 70 bp, Artificial Sequence
  Synthetic
gccaagcatttaggtgacactataggggagtcacctcgacactgagtttcagagctatgctggaaacagc

SEQ ID NO: 58829 - DNA, 70 bp, Artificial Sequence
  Synthetic
gccaagcatttaggtgacactatagatagcttcaacgtagttggcgtttcagagctatgctggaaacagc

SEQ ID NO: 58830 - DNA, 70 bp, Artificial Sequence
  Synthetic
gccaagcatttaggtgacactatagacaaactcaatgtaattcgcgtttcagagctatgctggaaacagc

SEQ ID NO: 58831 - DNA, 70 bp, Artificial Sequence
  Synthetic
gccaagcatttaggtgacactatagaggagacctcgtcttcatccgtttcagagctatgctggaaacagc

SEQ ID NO: 58832 - DNA, 70 bp, Artificial Sequence
  Synthetic
gccaagcatttaggtgacactatagctaggaacatctagttgttcgtttcagagctatgctggaaacagc

SEQ ID NO: 58833 - DNA, 70 bp, Artificial Sequence
  Synthetic
gccaagcatttaggtgacactatagtgcttggtgcacggtgggacgtttcagagctatgctggaaacagc

SEQ ID NO: 58834 - DNA, 70 bp, Artificial Sequence
  Synthetic
gccaagcatttaggtgacactataggttattcattatccaccagggtttcagagctatgctggaaacagc

SEQ ID NO: 58835 - DNA, 70 bp, Artificial Sequence
  Synthetic
gccaagcatttaggtgacactatagcaactgggtccagttctgaagtttcagagctatgctggaaacagc

SEQ ID NO: 58836 - DNA, 70 bp, Artificial Sequence
  Synthetic
gccaagcatttaggtgacactatagaaccgtgctcaggtcagaacgtttcagagctatgctggaaacagc

SEQ ID NO: 58837 - DNA, 70 bp, Artificial Sequence
  Synthetic
gccaagcatttaggtgacactatagcctcagctggcctgtgtttggtttcagagctatgctggaaacagc

SEQ ID NO: 58838 - DNA, 70 bp, Artificial Sequence
  Synthetic
gccaagcatttaggtgacactatagacaagagctaggatgttctggtttcagagctatgctggaaacagc

SEQ ID NO: 58839 - DNA, 70 bp, Artificial Sequence
  Synthetic
gccaagcatttaggtgacactatagctttcatttccaagaaggaggtttcagagctatgctggaaacagc

SEQ ID NO: 58840 - DNA, 70 bp, Artificial Sequence
  Synthetic
gccaagcatttaggtgacactataggtaaggacaaccgaacctcggtttcagagctatgctggaaacagc

SEQ ID NO: 58841 - DNA, 70 bp, Artificial Sequence
  Synthetic
gccaagcatttaggtgacactatagcgggcagtttatgtgtgaccgtttcagagctatgctggaaacagc

SEQ ID NO: 58842 - DNA, 70 bp, Artificial Sequence
  Synthetic
gccaagcatttaggtgacactatagcatggcagctcacacatacagtttcagagctatgctggaaacagc

SEQ ID NO: 58843 - DNA, 70 bp, Artificial Sequence
  Synthetic
gccaagcatttaggtgacactatagaatcacacataatgttctcggtttcagagctatgctggaaacagc

SEQ ID NO: 58844 - DNA, 70 bp, Artificial Sequence
  Synthetic
gccaagcatttaggtgacactatagatcctcgatgtcagcagttggtttcagagctatgctggaaacagc

SEQ ID NO: 58845 - DNA, 70 bp, Artificial Sequence
  Synthetic
gccaagcatttaggtgacactatagccgtaatttccaggagggaggtttcagagctatgctggaaacagc

SEQ ID NO: 58846 - DNA, 70 bp, Artificial Sequence
  Synthetic
gccaagcatttaggtgacactatagaggcaggcctgggtcagaccgtttcagagctatgctggaaacagc

SEQ ID NO: 58847 - DNA, 70 bp, Artificial Sequence
  Synthetic
gccaagcatttaggtgacactatagctcagtgaatgaaggtttaggtttcagagctatgctggaaacagc

SEQ ID NO: 58848 - DNA, 70 bp, Artificial Sequence
  Synthetic
gccaagcatttaggtgacactataggaaaacacccagggctttgagtttcagagctatgctggaaacagc

SEQ ID NO: 58849 - DNA, 70 bp, Artificial Sequence
  Synthetic
gccaagcatttaggtgacactatagtgctcaaggatttgaagggggtttcagagctatgctggaaacagc

SEQ ID NO: 58850 - DNA, 70 bp, Artificial Sequence
  Synthetic
gccaagcatttaggtgacactataggaggtggtcttaggcagtgagtttcagagctatgctggaaacagc

SEQ ID NO: 58851 - DNA, 70 bp, Artificial Sequence
  Synthetic
gccaagcatttaggtgacactatagcaagcgctctttgctggagagtttcagagctatgctggaaacagc

SEQ ID NO: 58852 - DNA, 70 bp, Artificial Sequence
  Synthetic
gccaagcatttaggtgacactatagttcagtggaggttcacaagcgtttcagagctatgctggaaacagc

SEQ ID NO: 58853 - DNA, 70 bp, Artificial Sequence
  Synthetic
gccaagcatttaggtgacactatagaaggccgccaaggggaagtagtttcagagctatgctggaaacagc

SEQ ID NO: 58854 - DNA, 70 bp, Artificial Sequence
  Synthetic
gccaagcatttaggtgacactataggaaagttgaaggtgctgggggtttcagagctatgctggaaacagc

SEQ ID NO: 58855 - DNA, 70 bp, Artificial Sequence
  Synthetic
gccaagcatttaggtgacactataggactcaaatcttagtcactcgtttcagagctatgctggaaacagc

SEQ ID NO: 58856 - DNA, 70 bp, Artificial Sequence
  Synthetic
gccaagcatttaggtgacactatagattgtagaatggcattcttcgtttcagagctatgctggaaacagc

SEQ ID NO: 58857 - DNA, 70 bp, Artificial Sequence
  Synthetic
gccaagcatttaggtgacactatagggggacctcagcctcttagcgtttcagagctatgctggaaacagc

SEQ ID NO: 58858 - DNA, 70 bp, Artificial Sequence
  Synthetic
gccaagcatttaggtgacactatagacaatcatttgctgaagcaggtttcagagctatgctggaaacagc

SEQ ID NO: 58859 - DNA, 70 bp, Artificial Sequence
  Synthetic
gccaagcatttaggtgacactataggagcagtgccagttctcctagtttcagagctatgctggaaacagc

SEQ ID NO: 58860 - DNA, 70 bp, Artificial Sequence
  Synthetic
gccaagcatttaggtgacactatagatctacagatattagcatccgtttcagagctatgctggaaacagc

SEQ ID NO: 58861 - DNA, 70 bp, Artificial Sequence
  Synthetic
gccaagcatttaggtgacactatagcttcatttagtcatggcagagtttcagagctatgctggaaacagc

SEQ ID NO: 58862 - DNA, 70 bp, Artificial Sequence
  Synthetic
gccaagcatttaggtgacactatagaggagccagcacgttttatggtttcagagctatgctggaaacagc

SEQ ID NO: 58863 - DNA, 70 bp, Artificial Sequence
  Synthetic
gccaagcatttaggtgacactatagtcttttggttgggtgattctgtttcagagctatgctggaaacagc

SEQ ID NO: 58864 - DNA, 70 bp, Artificial Sequence
  Synthetic
gccaagcatttaggtgacactatagacatctgaccttggataccagtttcagagctatgctggaaacagc

SEQ ID NO: 58865 - DNA, 70 bp, Artificial Sequence
  Synthetic
gccaagcatttaggtgacactataggaggatgccacatctgacctgtttcagagctatgctggaaacagc

SEQ ID NO: 58866 - DNA, 70 bp, Artificial Sequence
  Synthetic
gccaagcatttaggtgacactataggcaactgctcttcaaagtacgtttcagagctatgctggaaacagc

SEQ ID NO: 58867 - DNA, 70 bp, Artificial Sequence
  Synthetic
gccaagcatttaggtgacactatagttttgatagttgcctagagagtttcagagctatgctggaaacagc

SEQ ID NO: 58868 - DNA, 70 bp, Artificial Sequence
  Synthetic
gccaagcatttaggtgacactatagatcctgggcatgcgctagccgtttcagagctatgctggaaacagc

SEQ ID NO: 58869 - DNA, 70 bp, Artificial Sequence
  Synthetic
gccaagcatttaggtgacactatagtcaacttggtcaacagaagcgtttcagagctatgctggaaacagc

SEQ ID NO: 58870 - DNA, 70 bp, Artificial Sequence
  Synthetic
gccaagcatttaggtgacactatagtgggcaacaaagtgagactcgtttcagagctatgctggaaacagc

SEQ ID NO: 58871 - DNA, 70 bp, Artificial Sequence
  Synthetic
gccaagcatttaggtgacactatagtcaggcattatctgtcgcacgtttcagagctatgctggaaacagc

SEQ ID NO: 58872 - DNA, 70 bp, Artificial Sequence
  Synthetic
gccaagcatttaggtgacactatagggaggatgaatttgatagaggtttcagagctatgctggaaacagc

SEQ ID NO: 58873 - DNA, 70 bp, Artificial Sequence
  Synthetic
gccaagcatttaggtgacactataggtacgtttgcgggagcacatgtttcagagctatgctggaaacagc

SEQ ID NO: 58874 - DNA, 70 bp, Artificial Sequence
  Synthetic
gccaagcatttaggtgacactataggagaagtagactatcacatcgtttcagagctatgctggaaacagc

SEQ ID NO: 58875 - DNA, 70 bp, Artificial Sequence
  Synthetic
gccaagcatttaggtgacactataggtgcatccacgctcaggtgcgtttcagagctatgctggaaacagc

SEQ ID NO: 58876 - DNA, 70 bp, Artificial Sequence
  Synthetic
gccaagcatttaggtgacactatagatgtttatgacgtagcaaaggtttcagagctatgctggaaacagc

SEQ ID NO: 58877 - DNA, 70 bp, Artificial Sequence
  Synthetic
gccaagcatttaggtgacactatagggtgaatccgggtgcctcaggtttcagagctatgctggaaacagc

SEQ ID NO: 58878 - DNA, 70 bp, Artificial Sequence
  Synthetic
gccaagcatttaggtgacactatagaggctcaggagactagaggcgtttcagagctatgctggaaacagc

SEQ ID NO: 58879 - DNA, 70 bp, Artificial Sequence
  Synthetic
gccaagcatttaggtgacactatagcaggtggttctaggacacatgtttcagagctatgctggaaacagc

SEQ ID NO: 58880 - DNA, 70 bp, Artificial Sequence
  Synthetic
gccaagcatttaggtgacactatagccgcccctgccccgctctgagtttcagagctatgctggaaacagc

SEQ ID NO: 58881 - DNA, 70 bp, Artificial Sequence
  Synthetic
gccaagcatttaggtgacactatagaggcgagcatgaccctgtgagtttcagagctatgctggaaacagc

SEQ ID NO: 58882 - DNA, 70 bp, Artificial Sequence
  Synthetic
gccaagcatttaggtgacactatagaaccttgtggatggcttctagtttcagagctatgctggaaacagc

SEQ ID NO: 58883 - DNA, 70 bp, Artificial Sequence
  Synthetic
gccaagcatttaggtgacactatagtggaagagtctgttgttctggtttcagagctatgctggaaacagc

SEQ ID NO: 58884 - DNA, 70 bp, Artificial Sequence
  Synthetic
gccaagcatttaggtgacactataggttaacttcacagttcctgagtttcagagctatgctggaaacagc

SEQ ID NO: 58885 - DNA, 70 bp, Artificial Sequence
  Synthetic
gccaagcatttaggtgacactataggcagacactttcactttgccgtttcagagctatgctggaaacagc

SEQ ID NO: 58886 - DNA, 70 bp, Artificial Sequence
  Synthetic
gccaagcatttaggtgacactatagacagaacaactttctaacctgtttcagagctatgctggaaacagc

SEQ ID NO: 58887 - DNA, 70 bp, Artificial Sequence
  Synthetic
gccaagcatttaggtgacactataggtcgcatgtcaggcagtactgtttcagagctatgctggaaacagc

SEQ ID NO: 58888 - DNA, 70 bp, Artificial Sequence
  Synthetic
gccaagcatttaggtgacactatagccagccccattttgacatcagtttcagagctatgctggaaacagc

SEQ ID NO: 58889 - DNA, 70 bp, Artificial Sequence
  Synthetic
gccaagcatttaggtgacactatagatgctgttgtgatagcgtttgtttcagagctatgctggaaacagc

SEQ ID NO: 58890 - DNA, 70 bp, Artificial Sequence
  Synthetic
gccaagcatttaggtgacactatagaatgtcatctgtctccttaagtttcagagctatgctggaaacagc

SEQ ID NO: 58891 - DNA, 70 bp, Artificial Sequence
  Synthetic
gccaagcatttaggtgacactatagctggtcctcaggggaggactgtttcagagctatgctggaaacagc

SEQ ID NO: 58892 - DNA, 70 bp, Artificial Sequence
  Synthetic
gccaagcatttaggtgacactatagtggcaaacggaaagagacttgtttcagagctatgctggaaacagc

SEQ ID NO: 58893 - DNA, 70 bp, Artificial Sequence
  Synthetic
gccaagcatttaggtgacactatagaaggagtttgccttttattcgtttcagagctatgctggaaacagc

SEQ ID NO: 58894 - DNA, 70 bp, Artificial Sequence
  Synthetic
gccaagcatttaggtgacactataggtttgcttagagacccaatggtttcagagctatgctggaaacagc

SEQ ID NO: 58895 - DNA, 70 bp, Artificial Sequence
  Synthetic
gccaagcatttaggtgacactatagagcagaagattagaagtcaagtttcagagctatgctggaaacagc

SEQ ID NO: 58896 - DNA, 70 bp, Artificial Sequence
  Synthetic
gccaagcatttaggtgacactatagtggccaaaatcagtgtctatgtttcagagctatgctggaaacagc

SEQ ID NO: 58897 - DNA, 70 bp, Artificial Sequence
  Synthetic
gccaagcatttaggtgacactatagcactgaggcaggtactcagcgtttcagagctatgctggaaacagc

SEQ ID NO: 58898 - DNA, 70 bp, Artificial Sequence
  Synthetic
gccaagcatttaggtgacactatagaattggcttgggttcctaccgtttcagagctatgctggaaacagc

SEQ ID NO: 58899 - DNA, 70 bp, Artificial Sequence
  Synthetic
gccaagcatttaggtgacactataggtgctgctggccctcctgacgtttcagagctatgctggaaacagc

SEQ ID NO: 58900 - DNA, 70 bp, Artificial Sequence
  Synthetic
gccaagcatttaggtgacactatagccgcaacgggctaggagctggtttcagagctatgctggaaacagc

SEQ ID NO: 58901 - DNA, 70 bp, Artificial Sequence
  Synthetic
gccaagcatttaggtgacactatagaggacgtcattaagatctacgtttcagagctatgctggaaacagc

SEQ ID NO: 58902 - DNA, 70 bp, Artificial Sequence
  Synthetic
gccaagcatttaggtgacactatagccacctgcccaaagaacttagtttcagagctatgctggaaacagc

SEQ ID NO: 58903 - DNA, 70 bp, Artificial Sequence
  Synthetic
gccaagcatttaggtgacactatagtgctcctttgtatcactagggtttcagagctatgctggaaacagc

SEQ ID NO: 58904 - DNA, 70 bp, Artificial Sequence
  Synthetic
gccaagcatttaggtgacactatagcgccccgctctgggccgtgagtttcagagctatgctggaaacagc

SEQ ID NO: 58905 - DNA, 70 bp, Artificial Sequence
  Synthetic
gccaagcatttaggtgacactatagggttgaggaaggctcatgaagtttcagagctatgctggaaacagc

SEQ ID NO: 58906 - DNA, 70 bp, Artificial Sequence
  Synthetic
gccaagcatttaggtgacactataggctggtacgggtggaatgaggtttcagagctatgctggaaacagc

SEQ ID NO: 58907 - DNA, 70 bp, Artificial Sequence
  Synthetic
gccaagcatttaggtgacactatagcatgaaatatggcattgagcgtttcagagctatgctggaaacagc

SEQ ID NO: 58908 - DNA, 70 bp, Artificial Sequence
  Synthetic
gccaagcatttaggtgacactatagcgaccggggccccatgtacggtttcagagctatgctggaaacagc

SEQ ID NO: 58909 - DNA, 70 bp, Artificial Sequence
  Synthetic
gccaagcatttaggtgacactatagaatacagtcttcactgagtggtttcagagctatgctggaaacagc

SEQ ID NO: 58910 - DNA, 70 bp, Artificial Sequence
  Synthetic
gccaagcatttaggtgacactatagcatcttgcattgtgagagatgtttcagagctatgctggaaacagc

SEQ ID NO: 58911 - DNA, 70 bp, Artificial Sequence
  Synthetic
gccaagcatttaggtgacactatagagtgtctacaaagggcctaggtttcagagctatgctggaaacagc

SEQ ID NO: 58912 - DNA, 70 bp, Artificial Sequence
  Synthetic
gccaagcatttaggtgacactataggcagctctagatacaatcccgtttcagagctatgctggaaacagc

SEQ ID NO: 58913 - DNA, 70 bp, Artificial Sequence
  Synthetic
gccaagcatttaggtgacactatagctgcttgagcccaggcagtcgtttcagagctatgctggaaacagc

SEQ ID NO: 58914 - DNA, 70 bp, Artificial Sequence
  Synthetic
gccaagcatttaggtgacactatagcgagtctcttcttcaaacacgtttcagagctatgctggaaacagc

SEQ ID NO: 58915 - DNA, 70 bp, Artificial Sequence
  Synthetic
gccaagcatttaggtgacactataggaaactttcccagaagatgggtttcagagctatgctggaaacagc

SEQ ID NO: 58916 - DNA, 70 bp, Artificial Sequence
  Synthetic
gccaagcatttaggtgacactataggtgcagaagcaaagaagcgcgtttcagagctatgctggaaacagc

SEQ ID NO: 58917 - DNA, 70 bp, Artificial Sequence
  Synthetic
gccaagcatttaggtgacactatagtgctcctgtagaaacattttgtttcagagctatgctggaaacagc

SEQ ID NO: 58918 - DNA, 70 bp, Artificial Sequence
  Synthetic
gccaagcatttaggtgacactatagcttctttgaagagctctagcgtttcagagctatgctggaaacagc

SEQ ID NO: 58919 - DNA, 70 bp, Artificial Sequence
  Synthetic
gccaagcatttaggtgacactatagttgagggctcaaatgcagatgtttcagagctatgctggaaacagc

SEQ ID NO: 58920 - DNA, 70 bp, Artificial Sequence
  Synthetic
gccaagcatttaggtgacactatagatggcaaggagggctttagcgtttcagagctatgctggaaacagc

SEQ ID NO: 58921 - DNA, 70 bp, Artificial Sequence
  Synthetic
gccaagcatttaggtgacactatagctatctactctctggcctaagtttcagagctatgctggaaacagc

SEQ ID NO: 58922 - DNA, 70 bp, Artificial Sequence
  Synthetic
gccaagcatttaggtgacactataggggtggggctggtcagtgccgtttcagagctatgctggaaacagc

SEQ ID NO: 58923 - DNA, 70 bp, Artificial Sequence
  Synthetic
gccaagcatttaggtgacactatagcttgactggctccttttaacgtttcagagctatgctggaaacagc

SEQ ID NO: 58924 - DNA, 70 bp, Artificial Sequence
  Synthetic
gccaagcatttaggtgacactatagctgctgtggcagcagggccggtttcagagctatgctggaaacagc

SEQ ID NO: 58925 - DNA, 70 bp, Artificial Sequence
  Synthetic
gccaagcatttaggtgacactataggccgtgaacatgagcgcgtggtttcagagctatgctggaaacagc

SEQ ID NO: 58926 - DNA, 70 bp, Artificial Sequence
  Synthetic
gccaagcatttaggtgacactatagtccaatgtggcaactaggaggtttcagagctatgctggaaacagc

SEQ ID NO: 58927 - DNA, 70 bp, Artificial Sequence
  Synthetic
gccaagcatttaggtgacactatagtgatagacacacaccttagcgtttcagagctatgctggaaacagc

SEQ ID NO: 58928 - DNA, 70 bp, Artificial Sequence
  Synthetic
gccaagcatttaggtgacactatagttttacgtctgatttctggcgtttcagagctatgctggaaacagc

SEQ ID NO: 58929 - DNA, 70 bp, Artificial Sequence
  Synthetic
gccaagcatttaggtgacactatagggggacctcattgaggtctggtttcagagctatgctggaaacagc

SEQ ID NO: 58930 - DNA, 70 bp, Artificial Sequence
  Synthetic
gccaagcatttaggtgacactatagctcctttctggagaatctaggtttcagagctatgctggaaacagc

SEQ ID NO: 58931 - DNA, 70 bp, Artificial Sequence
  Synthetic
gccaagcatttaggtgacactatagtcccagcaggaagatatctggtttcagagctatgctggaaacagc

SEQ ID NO: 58932 - DNA, 70 bp, Artificial Sequence
  Synthetic
gccaagcatttaggtgacactatagtggatttaggaagatctgatgtttcagagctatgctggaaacagc

SEQ ID NO: 58933 - DNA, 70 bp, Artificial Sequence
  Synthetic
gccaagcatttaggtgacactatagacagttcacgtggttcaggcgtttcagagctatgctggaaacagc

SEQ ID NO: 58934 - DNA, 70 bp, Artificial Sequence
  Synthetic
gccaagcatttaggtgacactatagttgctctgcatgtttgctgagtttcagagctatgctggaaacagc

SEQ ID NO: 58935 - DNA, 70 bp, Artificial Sequence
  Synthetic
gccaagcatttaggtgacactatagatggaggccacagactgagcgtttcagagctatgctggaaacagc

SEQ ID NO: 58936 - DNA, 70 bp, Artificial Sequence
  Synthetic
gccaagcatttaggtgacactatagttccccaggctcactttctcgtttcagagctatgctggaaacagc

SEQ ID NO: 58937 - DNA, 70 bp, Artificial Sequence
  Synthetic
gccaagcatttaggtgacactatagaacatctggcttcttactttgtttcagagctatgctggaaacagc

SEQ ID NO: 58938 - DNA, 70 bp, Artificial Sequence
  Synthetic
gccaagcatttaggtgacactatagctcactttctctttccctttgtttcagagctatgctggaaacagc

SEQ ID NO: 58939 - DNA, 70 bp, Artificial Sequence
  Synthetic
gccaagcatttaggtgacactatagcatcgcttcatctgagccaagtttcagagctatgctggaaacagc

SEQ ID NO: 58940 - DNA, 70 bp, Artificial Sequence
  Synthetic
gccaagcatttaggtgacactatagcccttctcaactctgtaacagtttcagagctatgctggaaacagc

SEQ ID NO: 58941 - DNA, 70 bp, Artificial Sequence
  Synthetic
gccaagcatttaggtgacactataggacgctgcaacttttatcccgtttcagagctatgctggaaacagc

SEQ ID NO: 58942 - DNA, 70 bp, Artificial Sequence
  Synthetic
gccaagcatttaggtgacactatagaagcagaaacaagcaactgagtttcagagctatgctggaaacagc

SEQ ID NO: 58943 - DNA, 70 bp, Artificial Sequence
  Synthetic
gccaagcatttaggtgacactatagtcctggtacctgggctagctgtttcagagctatgctggaaacagc

SEQ ID NO: 58944 - DNA, 70 bp, Artificial Sequence
  Synthetic
gccaagcatttaggtgacactatagaaccgttcctttgtgggattgtttcagagctatgctggaaacagc

SEQ ID NO: 58945 - DNA, 70 bp, Artificial Sequence
  Synthetic
gccaagcatttaggtgacactatagcctttgctatcccagataccgtttcagagctatgctggaaacagc

SEQ ID NO: 58946 - DNA, 70 bp, Artificial Sequence
  Synthetic
gccaagcatttaggtgacactatagcaatctctgcttcagactctgtttcagagctatgctggaaacagc

SEQ ID NO: 58947 - DNA, 70 bp, Artificial Sequence
  Synthetic
gccaagcatttaggtgacactatagtcttttgtcgatcttatcaggtttcagagctatgctggaaacagc

SEQ ID NO: 58948 - DNA, 70 bp, Artificial Sequence
  Synthetic
gccaagcatttaggtgacactatagtgttcagaaagttgccgtccgtttcagagctatgctggaaacagc

SEQ ID NO: 58949 - DNA, 70 bp, Artificial Sequence
  Synthetic
gccaagcatttaggtgacactatagggctaaattttgccttctaggtttcagagctatgctggaaacagc

SEQ ID NO: 58950 - DNA, 70 bp, Artificial Sequence
  Synthetic
gccaagcatttaggtgacactataggcagcaggtcagtgcacctggtttcagagctatgctggaaacagc

SEQ ID NO: 58951 - DNA, 70 bp, Artificial Sequence
  Synthetic
gccaagcatttaggtgacactataggcgctcataacgtcagacgcgtttcagagctatgctggaaacagc

SEQ ID NO: 58952 - DNA, 70 bp, Artificial Sequence
  Synthetic
gccaagcatttaggtgacactatagacaatgaaacaaatcacacggtttcagagctatgctggaaacagc

SEQ ID NO: 58953 - DNA, 70 bp, Artificial Sequence
  Synthetic
gccaagcatttaggtgacactataggtctgggtttgagtcctaaggtttcagagctatgctggaaacagc

SEQ ID NO: 58954 - DNA, 70 bp, Artificial Sequence
  Synthetic
gccaagcatttaggtgacactatagagaccctgcctggcttcagtgtttcagagctatgctggaaacagc

SEQ ID NO: 58955 - DNA, 70 bp, Artificial Sequence
  Synthetic
gccaagcatttaggtgacactatagttcttccctagggtcacttggtttcagagctatgctggaaacagc

SEQ ID NO: 58956 - DNA, 70 bp, Artificial Sequence
  Synthetic
gccaagcatttaggtgacactatagccaagctaatggagctaatagtttcagagctatgctggaaacagc

SEQ ID NO: 58957 - DNA, 70 bp, Artificial Sequence
  Synthetic
gccaagcatttaggtgacactatagtctcataatcattgttgctcgtttcagagctatgctggaaacagc

SEQ ID NO: 58958 - DNA, 70 bp, Artificial Sequence
  Synthetic
gccaagcatttaggtgacactataggggccctattcttctagtgtgtttcagagctatgctggaaacagc

SEQ ID NO: 58959 - DNA, 70 bp, Artificial Sequence
  Synthetic
gccaagcatttaggtgacactatagggaggtagaaggcgtagaacgtttcagagctatgctggaaacagc

SEQ ID NO: 58960 - DNA, 70 bp, Artificial Sequence
  Synthetic
gccaagcatttaggtgacactatagcatcatgatcttcttagtccgtttcagagctatgctggaaacagc

SEQ ID NO: 58961 - DNA, 70 bp, Artificial Sequence
  Synthetic
gccaagcatttaggtgacactatagtgctataaacatgcgtgtgcgtttcagagctatgctggaaacagc

SEQ ID NO: 58962 - DNA, 70 bp, Artificial Sequence
  Synthetic
gccaagcatttaggtgacactataggacatcatgggtgatgtaccgtttcagagctatgctggaaacagc

SEQ ID NO: 58963 - DNA, 70 bp, Artificial Sequence
  Synthetic
gccaagcatttaggtgacactatagtggcgtggggttaggacactgtttcagagctatgctggaaacagc

SEQ ID NO: 58964 - DNA, 70 bp, Artificial Sequence
  Synthetic
gccaagcatttaggtgacactatagattttgttgttgaccgtctggtttcagagctatgctggaaacagc

SEQ ID NO: 58965 - DNA, 70 bp, Artificial Sequence
  Synthetic
gccaagcatttaggtgacactatagcccaggtgaccggcgactgagtttcagagctatgctggaaacagc

SEQ ID NO: 58966 - DNA, 70 bp, Artificial Sequence
  Synthetic
gccaagcatttaggtgacactatagaggctgggatggcgagtaaggtttcagagctatgctggaaacagc

SEQ ID NO: 58967 - DNA, 70 bp, Artificial Sequence
  Synthetic
gccaagcatttaggtgacactatagcagaaaggtcggaagaaaaagtttcagagctatgctggaaacagc

SEQ ID NO: 58968 - DNA, 70 bp, Artificial Sequence
  Synthetic
gccaagcatttaggtgacactataggtgggggtcattgccgattcgtttcagagctatgctggaaacagc

SEQ ID NO: 58969 - DNA, 70 bp, Artificial Sequence
  Synthetic
gccaagcatttaggtgacactatagtgtgtgtgtgctcagcaggagtttcagagctatgctggaaacagc

SEQ ID NO: 58970 - DNA, 70 bp, Artificial Sequence
  Synthetic
gccaagcatttaggtgacactatagctccccggttgggctcacacgtttcagagctatgctggaaacagc

SEQ ID NO: 58971 - DNA, 70 bp, Artificial Sequence
  Synthetic
gccaagcatttaggtgacactatagtggtgccactgaagttatttgtttcagagctatgctggaaacagc

SEQ ID NO: 58972 - DNA, 70 bp, Artificial Sequence
  Synthetic
gccaagcatttaggtgacactatagttaagctttgtctaaacagcgtttcagagctatgctggaaacagc

SEQ ID NO: 58973 - DNA, 70 bp, Artificial Sequence
  Synthetic
gccaagcatttaggtgacactatagttcctgtacagaatttgagtgtttcagagctatgctggaaacagc

SEQ ID NO: 58974 - DNA, 70 bp, Artificial Sequence
  Synthetic
gccaagcatttaggtgacactataggattaactgaagagacccctgtttcagagctatgctggaaacagc

SEQ ID NO: 58975 - DNA, 70 bp, Artificial Sequence
  Synthetic
gccaagcatttaggtgacactataggagttcagacgtccagcacggtttcagagctatgctggaaacagc

SEQ ID NO: 58976 - DNA, 70 bp, Artificial Sequence
  Synthetic
gccaagcatttaggtgacactatagcacgtcctggacgtgtaggggtttcagagctatgctggaaacagc

SEQ ID NO: 58977 - DNA, 70 bp, Artificial Sequence
  Synthetic
gccaagcatttaggtgacactatagtaaagttgactgggggtgatgtttcagagctatgctggaaacagc

SEQ ID NO: 58978 - DNA, 70 bp, Artificial Sequence
  Synthetic
gccaagcatttaggtgacactataggcatagctccagtagagctcgtttcagagctatgctggaaacagc

SEQ ID NO: 58979 - DNA, 70 bp, Artificial Sequence
  Synthetic
gccaagcatttaggtgacactataggcagtctatgtagcagaaatgtttcagagctatgctggaaacagc

SEQ ID NO: 58980 - DNA, 70 bp, Artificial Sequence
  Synthetic
gccaagcatttaggtgacactatagtgtctgggtcctgtgggtgggtttcagagctatgctggaaacagc

SEQ ID NO: 58981 - DNA, 70 bp, Artificial Sequence
  Synthetic
gccaagcatttaggtgacactataggggcttgaccattatcacacgtttcagagctatgctggaaacagc

SEQ ID NO: 58982 - DNA, 70 bp, Artificial Sequence
  Synthetic
gccaagcatttaggtgacactataggtgctaccggagcccctcatgtttcagagctatgctggaaacagc

SEQ ID NO: 58983 - DNA, 70 bp, Artificial Sequence
  Synthetic
gccaagcatttaggtgacactatagaggcagtctatgttgaactcgtttcagagctatgctggaaacagc

SEQ ID NO: 58984 - DNA, 70 bp, Artificial Sequence
  Synthetic
gccaagcatttaggtgacactatagtctctgagcgaggagagttagtttcagagctatgctggaaacagc

SEQ ID NO: 58985 - DNA, 70 bp, Artificial Sequence
  Synthetic
gccaagcatttaggtgacactatagagaccactaacccactggctgtttcagagctatgctggaaacagc

SEQ ID NO: 58986 - DNA, 70 bp, Artificial Sequence
  Synthetic
gccaagcatttaggtgacactatagcttgctctcctacacttgaagtttcagagctatgctggaaacagc

SEQ ID NO: 58987 - DNA, 70 bp, Artificial Sequence
  Synthetic
gccaagcatttaggtgacactatagttcgatacagtcaactcccagtttcagagctatgctggaaacagc

SEQ ID NO: 58988 - DNA, 70 bp, Artificial Sequence
  Synthetic
gccaagcatttaggtgacactataggtctacccctactgcccaacgtttcagagctatgctggaaacagc

SEQ ID NO: 58989 - DNA, 70 bp, Artificial Sequence
  Synthetic
gccaagcatttaggtgacactatagtgacagggaccctcttcagggtttcagagctatgctggaaacagc

SEQ ID NO: 58990 - DNA, 70 bp, Artificial Sequence
  Synthetic
gccaagcatttaggtgacactatagagaggatgacatttattcctgtttcagagctatgctggaaacagc

SEQ ID NO: 58991 - DNA, 70 bp, Artificial Sequence
  Synthetic
gccaagcatttaggtgacactatagctcaaacacctacacattcagtttcagagctatgctggaaacagc

SEQ ID NO: 58992 - DNA, 70 bp, Artificial Sequence
  Synthetic
gccaagcatttaggtgacactatagaagggtcccgtgtctacagagtttcagagctatgctggaaacagc

SEQ ID NO: 58993 - DNA, 70 bp, Artificial Sequence
  Synthetic
gccaagcatttaggtgacactatagaatagcagcccagttttcacgtttcagagctatgctggaaacagc

SEQ ID NO: 58994 - DNA, 70 bp, Artificial Sequence
  Synthetic
gccaagcatttaggtgacactatagtggtttggctatgacctcaagtttcagagctatgctggaaacagc

SEQ ID NO: 58995 - DNA, 70 bp, Artificial Sequence
  Synthetic
gccaagcatttaggtgacactatagtgtaaaactggagttaaagcgtttcagagctatgctggaaacagc

SEQ ID NO: 58996 - DNA, 70 bp, Artificial Sequence
  Synthetic
gccaagcatttaggtgacactatagctacggatggccactggctcgtttcagagctatgctggaaacagc

SEQ ID NO: 58997 - DNA, 70 bp, Artificial Sequence
  Synthetic
gccaagcatttaggtgacactataggtcccaggctgcattcagaggtttcagagctatgctggaaacagc

SEQ ID NO: 58998 - DNA, 70 bp, Artificial Sequence
  Synthetic
gccaagcatttaggtgacactatagtaatctgtctttacacagaggtttcagagctatgctggaaacagc

SEQ ID NO: 58999 - DNA, 70 bp, Artificial Sequence
  Synthetic
gccaagcatttaggtgacactatagcagacattggggaatatgtggtttcagagctatgctggaaacagc

SEQ ID NO: 59000 - DNA, 70 bp, Artificial Sequence
  Synthetic
gccaagcatttaggtgacactatagtagatttgttcatctccccagtttcagagctatgctggaaacagc

SEQ ID NO: 59001 - DNA, 70 bp, Artificial Sequence
  Synthetic
gccaagcatttaggtgacactataggaaaatgtctcccgaagaaagtttcagagctatgctggaaacagc

SEQ ID NO: 59002 - DNA, 70 bp, Artificial Sequence
  Synthetic
gccaagcatttaggtgacactataggtaacgtcatcattgtatccgtttcagagctatgctggaaacagc

SEQ ID NO: 59003 - DNA, 70 bp, Artificial Sequence
  Synthetic
gccaagcatttaggtgacactatagccaaagtggagagaagaaaggtttcagagctatgctggaaacagc

SEQ ID NO: 59004 - DNA, 70 bp, Artificial Sequence
  Synthetic
gccaagcatttaggtgacactatagtaggataagctatgtgaatcgtttcagagctatgctggaaacagc

SEQ ID NO: 59005 - DNA, 70 bp, Artificial Sequence
  Synthetic
gccaagcatttaggtgacactatagaggcgagtctcattccttctgtttcagagctatgctggaaacagc

SEQ ID NO: 59006 - DNA, 70 bp, Artificial Sequence
  Synthetic
gccaagcatttaggtgacactatagcaggtgcttgaattactcaagtttcagagctatgctggaaacagc

SEQ ID NO: 59007 - DNA, 70 bp, Artificial Sequence
  Synthetic
gccaagcatttaggtgacactatagcttgtcttgctctgtcacccgtttcagagctatgctggaaacagc

SEQ ID NO: 59008 - DNA, 70 bp, Artificial Sequence
  Synthetic
gccaagcatttaggtgacactatagcatattccaagcttcaggaagtttcagagctatgctggaaacagc

SEQ ID NO: 59009 - DNA, 70 bp, Artificial Sequence
  Synthetic
gccaagcatttaggtgacactatagcttcaggggtgaggcggagggtttcagagctatgctggaaacagc

SEQ ID NO: 59010 - DNA, 70 bp, Artificial Sequence
  Synthetic
gccaagcatttaggtgacactatagttagctggaagtcccatcctgtttcagagctatgctggaaacagc

SEQ ID NO: 59011 - DNA, 70 bp, Artificial Sequence
  Synthetic
gccaagcatttaggtgacactatagtgtaggcagcatcactgcaggtttcagagctatgctggaaacagc

SEQ ID NO: 59012 - DNA, 70 bp, Artificial Sequence
  Synthetic
gccaagcatttaggtgacactatagtagaaactctacagctttacgtttcagagctatgctggaaacagc

SEQ ID NO: 59013 - DNA, 70 bp, Artificial Sequence
  Synthetic
gccaagcatttaggtgacactatagttcagtggtgaaaacgatgtgtttcagagctatgctggaaacagc

SEQ ID NO: 59014 - DNA, 70 bp, Artificial Sequence
  Synthetic
gccaagcatttaggtgacactatagttcaatggtgaaaatgatgcgtttcagagctatgctggaaacagc

SEQ ID NO: 59015 - DNA, 70 bp, Artificial Sequence
  Synthetic
gccaagcatttaggtgacactataggatgtgggcatcagagcaatgtttcagagctatgctggaaacagc

SEQ ID NO: 59016 - DNA, 70 bp, Artificial Sequence
  Synthetic
gccaagcatttaggtgacactataggcttcactcactcatctccggtttcagagctatgctggaaacagc

SEQ ID NO: 59017 - DNA, 70 bp, Artificial Sequence
  Synthetic
gccaagcatttaggtgacactatagtggctgtggcctgggctagcgtttcagagctatgctggaaacagc

SEQ ID NO: 59018 - DNA, 70 bp, Artificial Sequence
  Synthetic
gccaagcatttaggtgacactataggaagtcaagtcttaagacaggtttcagagctatgctggaaacagc

SEQ ID NO: 59019 - DNA, 70 bp, Artificial Sequence
  Synthetic
gccaagcatttaggtgacactatagtgccctacgtcaccctcaaggtttcagagctatgctggaaacagc

SEQ ID NO: 59020 - DNA, 70 bp, Artificial Sequence
  Synthetic
gccaagcatttaggtgacactataggcgatcagacctctatgctggtttcagagctatgctggaaacagc

SEQ ID NO: 59021 - DNA, 70 bp, Artificial Sequence
  Synthetic
gccaagcatttaggtgacactataggctgcagcctctgtacacgtgtttcagagctatgctggaaacagc

SEQ ID NO: 59022 - DNA, 70 bp, Artificial Sequence
  Synthetic
gccaagcatttaggtgacactatagtgtaaatgagatgtcttctggtttcagagctatgctggaaacagc

SEQ ID NO: 59023 - DNA, 70 bp, Artificial Sequence
  Synthetic
gccaagcatttaggtgacactatagcggctgctgaacttgacttagtttcagagctatgctggaaacagc

SEQ ID NO: 59024 - DNA, 70 bp, Artificial Sequence
  Synthetic
gccaagcatttaggtgacactatagagctgtttcctcacttacgcgtttcagagctatgctggaaacagc

SEQ ID NO: 59025 - DNA, 70 bp, Artificial Sequence
  Synthetic
gccaagcatttaggtgacactatagttacagaaagaccaaagggagtttcagagctatgctggaaacagc

SEQ ID NO: 59026 - DNA, 70 bp, Artificial Sequence
  Synthetic
gccaagcatttaggtgacactatagtctttttgtgcaccatctctgtttcagagctatgctggaaacagc

SEQ ID NO: 59027 - DNA, 70 bp, Artificial Sequence
  Synthetic
gccaagcatttaggtgacactatagctggggaggggctctatgtcgtttcagagctatgctggaaacagc

SEQ ID NO: 59028 - DNA, 70 bp, Artificial Sequence
  Synthetic
gccaagcatttaggtgacactataggcttggcagtggcgctaggagtttcagagctatgctggaaacagc

SEQ ID NO: 59029 - DNA, 70 bp, Artificial Sequence
  Synthetic
gccaagcatttaggtgacactatagtagccaagtctgcagtcagagtttcagagctatgctggaaacagc

SEQ ID NO: 59030 - DNA, 70 bp, Artificial Sequence
  Synthetic
gccaagcatttaggtgacactataggctcttgccttctgctcacagtttcagagctatgctggaaacagc

SEQ ID NO: 59031 - DNA, 70 bp, Artificial Sequence
  Synthetic
gccaagcatttaggtgacactatagtgcctgggaggaaaaacaaagtttcagagctatgctggaaacagc

SEQ ID NO: 59032 - DNA, 70 bp, Artificial Sequence
  Synthetic
gccaagcatttaggtgacactatagggcagctcttcagccatccagtttcagagctatgctggaaacagc

SEQ ID NO: 59033 - DNA, 70 bp, Artificial Sequence
  Synthetic
gccaagcatttaggtgacactatagggggctgggtgagtggaattgtttcagagctatgctggaaacagc

SEQ ID NO: 59034 - DNA, 70 bp, Artificial Sequence
  Synthetic
gccaagcatttaggtgacactatagcagcccaggtgggccttaaagtttcagagctatgctggaaacagc

SEQ ID NO: 59035 - DNA, 70 bp, Artificial Sequence
  Synthetic
gccaagcatttaggtgacactataggaggcataacaagctcgtaagtttcagagctatgctggaaacagc

SEQ ID NO: 59036 - DNA, 70 bp, Artificial Sequence
  Synthetic
gccaagcatttaggtgacactatagactgtatctgctgctctcacgtttcagagctatgctggaaacagc

SEQ ID NO: 59037 - DNA, 70 bp, Artificial Sequence
  Synthetic
gccaagcatttaggtgacactataggaggtgcggcgcgtagaagggtttcagagctatgctggaaacagc

SEQ ID NO: 59038 - DNA, 70 bp, Artificial Sequence
  Synthetic
gccaagcatttaggtgacactataggggctccggattcatagacggtttcagagctatgctggaaacagc

SEQ ID NO: 59039 - DNA, 70 bp, Artificial Sequence
  Synthetic
gccaagcatttaggtgacactatagatacggtcggacctggtgaggtttcagagctatgctggaaacagc

SEQ ID NO: 59040 - DNA, 70 bp, Artificial Sequence
  Synthetic
gccaagcatttaggtgacactatagtccaggcccagcagtggactgtttcagagctatgctggaaacagc

SEQ ID NO: 59041 - DNA, 70 bp, Artificial Sequence
  Synthetic
gccaagcatttaggtgacactatagtgacccgccccgtccctaccgtttcagagctatgctggaaacagc

SEQ ID NO: 59042 - DNA, 70 bp, Artificial Sequence
  Synthetic
gccaagcatttaggtgacactatagacctgctctatggcaggacggtttcagagctatgctggaaacagc

SEQ ID NO: 59043 - DNA, 70 bp, Artificial Sequence
  Synthetic
gccaagcatttaggtgacactatagacgcgggtcccttccctaccgtttcagagctatgctggaaacagc

SEQ ID NO: 59044 - DNA, 70 bp, Artificial Sequence
  Synthetic
gccaagcatttaggtgacactatagcttttcggctctagggtcctgtttcagagctatgctggaaacagc

SEQ ID NO: 59045 - DNA, 70 bp, Artificial Sequence
  Synthetic
gccaagcatttaggtgacactatagtcggtggctcccagtgcactgtttcagagctatgctggaaacagc

SEQ ID NO: 59046 - DNA, 70 bp, Artificial Sequence
  Synthetic
gccaagcatttaggtgacactatagcgctgcagggtgtcagggccgtttcagagctatgctggaaacagc

SEQ ID NO: 59047 - DNA, 70 bp, Artificial Sequence
  Synthetic
gccaagcatttaggtgacactatagctggtctcctggaactggtggtttcagagctatgctggaaacagc

SEQ ID NO: 59048 - DNA, 70 bp, Artificial Sequence
  Synthetic
gccaagcatttaggtgacactataggcagctggagcccagcttttgtttcagagctatgctggaaacagc

SEQ ID NO: 59049 - DNA, 70 bp, Artificial Sequence
  Synthetic
gccaagcatttaggtgacactatagctcagcccaagcgggttcacgtttcagagctatgctggaaacagc

SEQ ID NO: 59050 - DNA, 70 bp, Artificial Sequence
  Synthetic
gccaagcatttaggtgacactatagggcgttcaggatgagctctcgtttcagagctatgctggaaacagc

SEQ ID NO: 59051 - DNA, 70 bp, Artificial Sequence
  Synthetic
gccaagcatttaggtgacactatagccaccccgcgggtcctcacagtttcagagctatgctggaaacagc

SEQ ID NO: 59052 - DNA, 70 bp, Artificial Sequence
  Synthetic
gccaagcatttaggtgacactataggtcagacgctgtgcgctcccgtttcagagctatgctggaaacagc

SEQ ID NO: 59053 - DNA, 70 bp, Artificial Sequence
  Synthetic
gccaagcatttaggtgacactataggtgggaaggacaaatgcctcgtttcagagctatgctggaaacagc

SEQ ID NO: 59054 - DNA, 70 bp, Artificial Sequence
  Synthetic
gccaagcatttaggtgacactatagtctcttatctggctatacccgtttcagagctatgctggaaacagc

SEQ ID NO: 59055 - DNA, 70 bp, Artificial Sequence
  Synthetic
gccaagcatttaggtgacactatagctccaccactcgggtatagggtttcagagctatgctggaaacagc

SEQ ID NO: 59056 - DNA, 70 bp, Artificial Sequence
  Synthetic
gccaagcatttaggtgacactatagctctgagttggagctataccgtttcagagctatgctggaaacagc

SEQ ID NO: 59057 - DNA, 70 bp, Artificial Sequence
  Synthetic
gccaagcatttaggtgacactatagagggcaaagctatactctaggtttcagagctatgctggaaacagc

SEQ ID NO: 59058 - DNA, 70 bp, Artificial Sequence
  Synthetic
gccaagcatttaggtgacactatagagggaaaagctatactctaggtttcagagctatgctggaaacagc

SEQ ID NO: 59059 - DNA, 70 bp, Artificial Sequence
  Synthetic
gccaagcatttaggtgacactatagtgcaagaggcacgtttgtgtgtttcagagctatgctggaaacagc

SEQ ID NO: 59060 - DNA, 70 bp, Artificial Sequence
  Synthetic
gccaagcatttaggtgacactatagctcctctggtgtgggagtgagtttcagagctatgctggaaacagc

SEQ ID NO: 59061 - DNA, 70 bp, Artificial Sequence
  Synthetic
gccaagcatttaggtgacactatagggcctgcatgctccgtgaacgtttcagagctatgctggaaacagc

SEQ ID NO: 59062 - DNA, 70 bp, Artificial Sequence
  Synthetic
gccaagcatttaggtgacactatagtcacatttcaacagtgcacggtttcagagctatgctggaaacagc

SEQ ID NO: 59063 - DNA, 70 bp, Artificial Sequence
  Synthetic
gccaagcatttaggtgacactatagaagaagctaggcttgttggggtttcagagctatgctggaaacagc

SEQ ID NO: 59064 - DNA, 70 bp, Artificial Sequence
  Synthetic
gccaagcatttaggtgacactatagaggccccttggggtacttgagtttcagagctatgctggaaacagc

SEQ ID NO: 59065 - DNA, 70 bp, Artificial Sequence
  Synthetic
gccaagcatttaggtgacactatagtgctgggcactagtatctccgtttcagagctatgctggaaacagc

SEQ ID NO: 59066 - DNA, 70 bp, Artificial Sequence
  Synthetic
gccaagcatttaggtgacactatagttgatacttcagctgctgaggtttcagagctatgctggaaacagc

SEQ ID NO: 59067 - DNA, 70 bp, Artificial Sequence
  Synthetic
gccaagcatttaggtgacactatagtggaaaaggcagagggacaggtttcagagctatgctggaaacagc

SEQ ID NO: 59068 - DNA, 70 bp, Artificial Sequence
  Synthetic
gccaagcatttaggtgacactatagtacgtacaacatgatcaaaggtttcagagctatgctggaaacagc

SEQ ID NO: 59069 - DNA, 70 bp, Artificial Sequence
  Synthetic
gccaagcatttaggtgacactatagtttggacattggctgctgaagtttcagagctatgctggaaacagc

SEQ ID NO: 59070 - DNA, 70 bp, Artificial Sequence
  Synthetic
gccaagcatttaggtgacactatagcatgcaggctgcagaaactcgtttcagagctatgctggaaacagc

SEQ ID NO: 59071 - DNA, 70 bp, Artificial Sequence
  Synthetic
gccaagcatttaggtgacactatagcctctctcactacattgtgcgtttcagagctatgctggaaacagc

SEQ ID NO: 59072 - DNA, 70 bp, Artificial Sequence
  Synthetic
gccaagcatttaggtgacactatagaagaagatgtgtcttggtgggtttcagagctatgctggaaacagc

SEQ ID NO: 59073 - DNA, 70 bp, Artificial Sequence
  Synthetic
gccaagcatttaggtgacactatagatcatgaagtcatgagaagagtttcagagctatgctggaaacagc

SEQ ID NO: 59074 - DNA, 70 bp, Artificial Sequence
  Synthetic
gccaagcatttaggtgacactatagcatgtttctcagttatcagcgtttcagagctatgctggaaacagc

SEQ ID NO: 59075 - DNA, 70 bp, Artificial Sequence
  Synthetic
gccaagcatttaggtgacactatagcgtctttgagccttcttggtgtttcagagctatgctggaaacagc

SEQ ID NO: 59076 - DNA, 70 bp, Artificial Sequence
  Synthetic
gccaagcatttaggtgacactatagcgactgtgacacaatcacaagtttcagagctatgctggaaacagc

SEQ ID NO: 59077 - DNA, 70 bp, Artificial Sequence
  Synthetic
gccaagcatttaggtgacactatagatgaagatgaccggtactgggtttcagagctatgctggaaacagc

SEQ ID NO: 59078 - DNA, 70 bp, Artificial Sequence
  Synthetic
gccaagcatttaggtgacactatagctggccaccagagcctcagagtttcagagctatgctggaaacagc

SEQ ID NO: 59079 - DNA, 70 bp, Artificial Sequence
  Synthetic
gccaagcatttaggtgacactatagcagcaaaaaaagtcacagcagtttcagagctatgctggaaacagc

SEQ ID NO: 59080 - DNA, 70 bp, Artificial Sequence
  Synthetic
gccaagcatttaggtgacactatagcctatcccagattaatccttgtttcagagctatgctggaaacagc

SEQ ID NO: 59081 - DNA, 70 bp, Artificial Sequence
  Synthetic
gccaagcatttaggtgacactatagaggggtgtgctcctctgatggtttcagagctatgctggaaacagc

SEQ ID NO: 59082 - DNA, 70 bp, Artificial Sequence
  Synthetic
gccaagcatttaggtgacactatagctggagcagctgggaagctcgtttcagagctatgctggaaacagc

SEQ ID NO: 59083 - DNA, 70 bp, Artificial Sequence
  Synthetic
gccaagcatttaggtgacactataggctcaggatttacatccagagtttcagagctatgctggaaacagc

SEQ ID NO: 59084 - DNA, 70 bp, Artificial Sequence
  Synthetic
gccaagcatttaggtgacactatagtttggggtgcggggcggctggtttcagagctatgctggaaacagc

SEQ ID NO: 59085 - DNA, 70 bp, Artificial Sequence
  Synthetic
gccaagcatttaggtgacactataggcacagcatgaagcaggaaagtttcagagctatgctggaaacagc

SEQ ID NO: 59086 - DNA, 70 bp, Artificial Sequence
  Synthetic
gccaagcatttaggtgacactatagcaagatgccactggtgaagagtttcagagctatgctggaaacagc

SEQ ID NO: 59087 - DNA, 70 bp, Artificial Sequence
  Synthetic
gccaagcatttaggtgacactatagcactgaggggccaagtgtgggtttcagagctatgctggaaacagc

SEQ ID NO: 59088 - DNA, 70 bp, Artificial Sequence
  Synthetic
gccaagcatttaggtgacactataggaactggatctatgaatgacgtttcagagctatgctggaaacagc

SEQ ID NO: 59089 - DNA, 70 bp, Artificial Sequence
  Synthetic
gccaagcatttaggtgacactatagtgactgggtctatgaataaggtttcagagctatgctggaaacagc

SEQ ID NO: 59090 - DNA, 70 bp, Artificial Sequence
  Synthetic
gccaagcatttaggtgacactatagctcagggccggttgtggccagtttcagagctatgctggaaacagc

SEQ ID NO: 59091 - DNA, 70 bp, Artificial Sequence
  Synthetic
gccaagcatttaggtgacactatagcactggctgtatgagtagccgtttcagagctatgctggaaacagc

SEQ ID NO: 59092 - DNA, 70 bp, Artificial Sequence
  Synthetic
gccaagcatttaggtgacactataggggcagcttgagcctcaggcgtttcagagctatgctggaaacagc

SEQ ID NO: 59093 - DNA, 70 bp, Artificial Sequence
  Synthetic
gccaagcatttaggtgacactatagcaggcttcatgtgcaccctggtttcagagctatgctggaaacagc

SEQ ID NO: 59094 - DNA, 70 bp, Artificial Sequence
  Synthetic
gccaagcatttaggtgacactatagacgtgatccagcgctttgaggtttcagagctatgctggaaacagc

SEQ ID NO: 59095 - DNA, 70 bp, Artificial Sequence
  Synthetic
gccaagcatttaggtgacactatagaaggttcttctacaattggagtttcagagctatgctggaaacagc

SEQ ID NO: 59096 - DNA, 70 bp, Artificial Sequence
  Synthetic
gccaagcatttaggtgacactatagggaggtgtccactatgtagcgtttcagagctatgctggaaacagc

SEQ ID NO: 59097 - DNA, 70 bp, Artificial Sequence
  Synthetic
gccaagcatttaggtgacactatagttcatagacctgcatcaggcgtttcagagctatgctggaaacagc

SEQ ID NO: 59098 - DNA, 70 bp, Artificial Sequence
  Synthetic
gccaagcatttaggtgacactataggccagaggatggcctattaggtttcagagctatgctggaaacagc

SEQ ID NO: 59099 - DNA, 70 bp, Artificial Sequence
  Synthetic
gccaagcatttaggtgacactatagtagactctttgaggatcctggtttcagagctatgctggaaacagc

SEQ ID NO: 59100 - DNA, 70 bp, Artificial Sequence
  Synthetic
gccaagcatttaggtgacactatagcctgaggatgtggattgagagtttcagagctatgctggaaacagc

SEQ ID NO: 59101 - DNA, 70 bp, Artificial Sequence
  Synthetic
gccaagcatttaggtgacactatagaggtcagtgatcttcaacctgtttcagagctatgctggaaacagc

SEQ ID NO: 59102 - DNA, 70 bp, Artificial Sequence
  Synthetic
gccaagcatttaggtgacactatagtcttcaaagtatgctatgtggtttcagagctatgctggaaacagc

SEQ ID NO: 59103 - DNA, 70 bp, Artificial Sequence
  Synthetic
gccaagcatttaggtgacactatagggcctggaaggaagaggaaggtttcagagctatgctggaaacagc

SEQ ID NO: 59104 - DNA, 70 bp, Artificial Sequence
  Synthetic
gccaagcatttaggtgacactatagcactgcagaagctaagacatgtttcagagctatgctggaaacagc

SEQ ID NO: 59105 - DNA, 70 bp, Artificial Sequence
  Synthetic
gccaagcatttaggtgacactataggaggacgaggggctgctagcgtttcagagctatgctggaaacagc

SEQ ID NO: 59106 - DNA, 70 bp, Artificial Sequence
  Synthetic
gccaagcatttaggtgacactataggagggcaagacaagctaggggtttcagagctatgctggaaacagc

SEQ ID NO: 59107 - DNA, 70 bp, Artificial Sequence
  Synthetic
gccaagcatttaggtgacactatagagcaagtagctctttccgtcgtttcagagctatgctggaaacagc

SEQ ID NO: 59108 - DNA, 70 bp, Artificial Sequence
  Synthetic
gccaagcatttaggtgacactatagcgaggcgggcaggtcacagcgtttcagagctatgctggaaacagc

SEQ ID NO: 59109 - DNA, 70 bp, Artificial Sequence
  Synthetic
gccaagcatttaggtgacactatagggatggaacaaaatctgaaggtttcagagctatgctggaaacagc

SEQ ID NO: 59110 - DNA, 70 bp, Artificial Sequence
  Synthetic
gccaagcatttaggtgacactatagacgctcacatgctgtcctgcgtttcagagctatgctggaaacagc

SEQ ID NO: 59111 - DNA, 70 bp, Artificial Sequence
  Synthetic
gccaagcatttaggtgacactatagtggaagaaacattgaagatggtttcagagctatgctggaaacagc

SEQ ID NO: 59112 - DNA, 70 bp, Artificial Sequence
  Synthetic
gccaagcatttaggtgacactatagagcatgggggcagagaaggtgtttcagagctatgctggaaacagc

SEQ ID NO: 59113 - DNA, 70 bp, Artificial Sequence
  Synthetic
gccaagcatttaggtgacactatagtggactagtactacaatagagtttcagagctatgctggaaacagc

SEQ ID NO: 59114 - DNA, 70 bp, Artificial Sequence
  Synthetic
gccaagcatttaggtgacactatagtcagcagggttcatttaaaagtttcagagctatgctggaaacagc

SEQ ID NO: 59115 - DNA, 70 bp, Artificial Sequence
  Synthetic
gccaagcatttaggtgacactatagagagaccgatccatcctgaggtttcagagctatgctggaaacagc

SEQ ID NO: 59116 - DNA, 70 bp, Artificial Sequence
  Synthetic
gccaagcatttaggtgacactatagttgacatctgttcactagaggtttcagagctatgctggaaacagc

SEQ ID NO: 59117 - DNA, 70 bp, Artificial Sequence
  Synthetic
gccaagcatttaggtgacactatagcacttggcaaggtcagtgaggtttcagagctatgctggaaacagc

SEQ ID NO: 59118 - DNA, 70 bp, Artificial Sequence
  Synthetic
gccaagcatttaggtgacactatagctgggagctggggcctcagtgtttcagagctatgctggaaacagc

SEQ ID NO: 59119 - DNA, 70 bp, Artificial Sequence
  Synthetic
gccaagcatttaggtgacactatagtgcctatgcccagatctcaggtttcagagctatgctggaaacagc

SEQ ID NO: 59120 - DNA, 70 bp, Artificial Sequence
  Synthetic
gccaagcatttaggtgacactatagattgaggtcacaggcatcacgtttcagagctatgctggaaacagc

SEQ ID NO: 59121 - DNA, 70 bp, Artificial Sequence
  Synthetic
gccaagcatttaggtgacactatagaggattctctaactttcgccgtttcagagctatgctggaaacagc

SEQ ID NO: 59122 - DNA, 70 bp, Artificial Sequence
  Synthetic
gccaagcatttaggtgacactatagtacaacgtgaggaagaagaagtttcagagctatgctggaaacagc

SEQ ID NO: 59123 - DNA, 70 bp, Artificial Sequence
  Synthetic
gccaagcatttaggtgacactatagaaacttctttctggaagcgtgtttcagagctatgctggaaacagc

SEQ ID NO: 59124 - DNA, 70 bp, Artificial Sequence
  Synthetic
gccaagcatttaggtgacactataggctattcttgtcatcccctcgtttcagagctatgctggaaacagc

SEQ ID NO: 59125 - DNA, 70 bp, Artificial Sequence
  Synthetic
gccaagcatttaggtgacactatagcagctctcagaggacgactggtttcagagctatgctggaaacagc

SEQ ID NO: 59126 - DNA, 70 bp, Artificial Sequence
  Synthetic
gccaagcatttaggtgacactatagagttgctactgaatcgcctcgtttcagagctatgctggaaacagc

SEQ ID NO: 59127 - DNA, 70 bp, Artificial Sequence
  Synthetic
gccaagcatttaggtgacactataggtcagctgagcgtgaagtgcgtttcagagctatgctggaaacagc

SEQ ID NO: 59128 - DNA, 70 bp, Artificial Sequence
  Synthetic
gccaagcatttaggtgacactatagagctttactgaggaatctgagtttcagagctatgctggaaacagc

SEQ ID NO: 59129 - DNA, 70 bp, Artificial Sequence
  Synthetic
gccaagcatttaggtgacactataggcggattatctgtttctgaggtttcagagctatgctggaaacagc

SEQ ID NO: 59130 - DNA, 70 bp, Artificial Sequence
  Synthetic
gccaagcatttaggtgacactataggagacttcaaagcaagagtcgtttcagagctatgctggaaacagc

SEQ ID NO: 59131 - DNA, 70 bp, Artificial Sequence
  Synthetic
gccaagcatttaggtgacactatagtccctccaggatgtcatcaggtttcagagctatgctggaaacagc

SEQ ID NO: 59132 - DNA, 70 bp, Artificial Sequence
  Synthetic
gccaagcatttaggtgacactatagctagcacgagcacttgcactgtttcagagctatgctggaaacagc

SEQ ID NO: 59133 - DNA, 70 bp, Artificial Sequence
  Synthetic
gccaagcatttaggtgacactatagggacggtcgtttcattgattgtttcagagctatgctggaaacagc

SEQ ID NO: 59134 - DNA, 70 bp, Artificial Sequence
  Synthetic
gccaagcatttaggtgacactatagtaatgatgccagaagcaaaggtttcagagctatgctggaaacagc

SEQ ID NO: 59135 - DNA, 70 bp, Artificial Sequence
  Synthetic
gccaagcatttaggtgacactatagaggcaaagcacggcacagcggtttcagagctatgctggaaacagc

SEQ ID NO: 59136 - DNA, 70 bp, Artificial Sequence
  Synthetic
gccaagcatttaggtgacactatagcgagcccgacttcgaggaaagtttcagagctatgctggaaacagc

SEQ ID NO: 59137 - DNA, 70 bp, Artificial Sequence
  Synthetic
gccaagcatttaggtgacactataggtgccccgcccatgctggatgtttcagagctatgctggaaacagc

SEQ ID NO: 59138 - DNA, 70 bp, Artificial Sequence
  Synthetic
gccaagcatttaggtgacactatagattgcgatctgcagatgaacgtttcagagctatgctggaaacagc

SEQ ID NO: 59139 - DNA, 70 bp, Artificial Sequence
  Synthetic
gccaagcatttaggtgacactatagtctcttcatgctgagatcaggtttcagagctatgctggaaacagc

SEQ ID NO: 59140 - DNA, 70 bp, Artificial Sequence
  Synthetic
gccaagcatttaggtgacactatagggtggggtcagttctgctgtgtttcagagctatgctggaaacagc

SEQ ID NO: 59141 - DNA, 70 bp, Artificial Sequence
  Synthetic
gccaagcatttaggtgacactatagcccacggacctcagcatgaagtttcagagctatgctggaaacagc

SEQ ID NO: 59142 - DNA, 70 bp, Artificial Sequence
  Synthetic
gccaagcatttaggtgacactatagtggaggcccgaagtgagagggtttcagagctatgctggaaacagc

SEQ ID NO: 59143 - DNA, 70 bp, Artificial Sequence
  Synthetic
gccaagcatttaggtgacactataggaggtttaaaagacggtggagtttcagagctatgctggaaacagc

SEQ ID NO: 59144 - DNA, 70 bp, Artificial Sequence
  Synthetic
gccaagcatttaggtgacactatagcagaacaaccaacctgcgtagtttcagagctatgctggaaacagc

SEQ ID NO: 59145 - DNA, 70 bp, Artificial Sequence
  Synthetic
gccaagcatttaggtgacactatagttcgacagaacttaggtcttgtttcagagctatgctggaaacagc

SEQ ID NO: 59146 - DNA, 70 bp, Artificial Sequence
  Synthetic
gccaagcatttaggtgacactataggggaggctcaatctctgtccgtttcagagctatgctggaaacagc

SEQ ID NO: 59147 - DNA, 70 bp, Artificial Sequence
  Synthetic
gccaagcatttaggtgacactataggcttccctgagaatgtagtcgtttcagagctatgctggaaacagc

SEQ ID NO: 59148 - DNA, 70 bp, Artificial Sequence
  Synthetic
gccaagcatttaggtgacactatagaagacaaggcggacttgagggtttcagagctatgctggaaacagc

SEQ ID NO: 59149 - DNA, 70 bp, Artificial Sequence
  Synthetic
gccaagcatttaggtgacactatagaagacaaggcggacgtgagggtttcagagctatgctggaaacagc

SEQ ID NO: 59150 - DNA, 70 bp, Artificial Sequence
  Synthetic
gccaagcatttaggtgacactatagaacctgtatccactattagggtttcagagctatgctggaaacagc

SEQ ID NO: 59151 - DNA, 70 bp, Artificial Sequence
  Synthetic
gccaagcatttaggtgacactatagtagtatcggcgacgtttgttgtttcagagctatgctggaaacagc

SEQ ID NO: 59152 - DNA, 70 bp, Artificial Sequence
  Synthetic
gccaagcatttaggtgacactatagtcagtttaagggaccctcaggtttcagagctatgctggaaacagc

SEQ ID NO: 59153 - DNA, 70 bp, Artificial Sequence
  Synthetic
gccaagcatttaggtgacactatagacttttttggctgggtgctggtttcagagctatgctggaaacagc

SEQ ID NO: 59154 - DNA, 70 bp, Artificial Sequence
  Synthetic
gccaagcatttaggtgacactataggcgaatggaaggctctgaaggtttcagagctatgctggaaacagc

SEQ ID NO: 59155 - DNA, 70 bp, Artificial Sequence
  Synthetic
gccaagcatttaggtgacactataggaacctgctgttttcagggtgtttcagagctatgctggaaacagc

SEQ ID NO: 59156 - DNA, 70 bp, Artificial Sequence
  Synthetic
gccaagcatttaggtgacactataggaagatggaggtggagtgacgtttcagagctatgctggaaacagc

SEQ ID NO: 59157 - DNA, 70 bp, Artificial Sequence
  Synthetic
gccaagcatttaggtgacactatagtcaaccgaaagcgtctgaacgtttcagagctatgctggaaacagc

SEQ ID NO: 59158 - DNA, 70 bp, Artificial Sequence
  Synthetic
gccaagcatttaggtgacactatagccagctgctgctatcttagagtttcagagctatgctggaaacagc

SEQ ID NO: 59159 - DNA, 70 bp, Artificial Sequence
  Synthetic
gccaagcatttaggtgacactatagggtgtcttgctttgtcgctcgtttcagagctatgctggaaacagc

SEQ ID NO: 59160 - DNA, 70 bp, Artificial Sequence
  Synthetic
gccaagcatttaggtgacactatagggtgaagctggtggagaagcgtttcagagctatgctggaaacagc

SEQ ID NO: 59161 - DNA, 70 bp, Artificial Sequence
  Synthetic
gccaagcatttaggtgacactatagaaagttccataaagcatcccgtttcagagctatgctggaaacagc

SEQ ID NO: 59162 - DNA, 70 bp, Artificial Sequence
  Synthetic
gccaagcatttaggtgacactataggcaattgctgtgctggtacagtttcagagctatgctggaaacagc

SEQ ID NO: 59163 - DNA, 70 bp, Artificial Sequence
  Synthetic
gccaagcatttaggtgacactatagaactccatacttgaagactggtttcagagctatgctggaaacagc

SEQ ID NO: 59164 - DNA, 70 bp, Artificial Sequence
  Synthetic
gccaagcatttaggtgacactatagaagggtctcttatcagctccgtttcagagctatgctggaaacagc

SEQ ID NO: 59165 - DNA, 70 bp, Artificial Sequence
  Synthetic
gccaagcatttaggtgacactataggctctcttcaatgaaggcaagtttcagagctatgctggaaacagc

SEQ ID NO: 59166 - DNA, 70 bp, Artificial Sequence
  Synthetic
gccaagcatttaggtgacactatagcctcgccctcggcacctacagtttcagagctatgctggaaacagc

SEQ ID NO: 59167 - DNA, 70 bp, Artificial Sequence
  Synthetic
gccaagcatttaggtgacactatagtggagatgtcagcgctctgagtttcagagctatgctggaaacagc

SEQ ID NO: 59168 - DNA, 70 bp, Artificial Sequence
  Synthetic
gccaagcatttaggtgacactataggagcaggcgaaactattctggtttcagagctatgctggaaacagc

SEQ ID NO: 59169 - DNA, 70 bp, Artificial Sequence
  Synthetic
gccaagcatttaggtgacactatagcttcaacctcccaagtagttgtttcagagctatgctggaaacagc

SEQ ID NO: 59170 - DNA, 70 bp, Artificial Sequence
  Synthetic
gccaagcatttaggtgacactatagcgtctataatcgcagcacttgtttcagagctatgctggaaacagc

SEQ ID NO: 59171 - DNA, 70 bp, Artificial Sequence
  Synthetic
gccaagcatttaggtgacactataggaaagccaggcggctctcaggtttcagagctatgctggaaacagc

SEQ ID NO: 59172 - DNA, 70 bp, Artificial Sequence
  Synthetic
gccaagcatttaggtgacactataggaaatcacggccggtgatgcgtttcagagctatgctggaaacagc

SEQ ID NO: 59173 - DNA, 70 bp, Artificial Sequence
  Synthetic
gccaagcatttaggtgacactatagtgctggcaacacagctacaagtttcagagctatgctggaaacagc

SEQ ID NO: 59174 - DNA, 70 bp, Artificial Sequence
  Synthetic
gccaagcatttaggtgacactatagtccggaggccttcaagtaaagtttcagagctatgctggaaacagc

SEQ ID NO: 59175 - DNA, 70 bp, Artificial Sequence
  Synthetic
gccaagcatttaggtgacactataggccaccacacaacaacatgcgtttcagagctatgctggaaacagc

SEQ ID NO: 59176 - DNA, 70 bp, Artificial Sequence
  Synthetic
gccaagcatttaggtgacactatagtataacttaagacaatgcccgtttcagagctatgctggaaacagc

SEQ ID NO: 59177 - DNA, 70 bp, Artificial Sequence
  Synthetic
gccaagcatttaggtgacactatagagagacagggaagtctggaagtttcagagctatgctggaaacagc

SEQ ID NO: 59178 - DNA, 70 bp, Artificial Sequence
  Synthetic
gccaagcatttaggtgacactatagtacccccaagaggcaagtgtgtttcagagctatgctggaaacagc

SEQ ID NO: 59179 - DNA, 70 bp, Artificial Sequence
  Synthetic
gccaagcatttaggtgacactatagcccataaaccaaggaggagagtttcagagctatgctggaaacagc

SEQ ID NO: 59180 - DNA, 70 bp, Artificial Sequence
  Synthetic
gccaagcatttaggtgacactataggatgccgagtcaggagtggagtttcagagctatgctggaaacagc

SEQ ID NO: 59181 - DNA, 70 bp, Artificial Sequence
  Synthetic
gccaagcatttaggtgacactataggatgctgagcaacggaagctgtttcagagctatgctggaaacagc

SEQ ID NO: 59182 - DNA, 70 bp, Artificial Sequence
  Synthetic
gccaagcatttaggtgacactataggacaggttacattttccctcgtttcagagctatgctggaaacagc

SEQ ID NO: 59183 - DNA, 70 bp, Artificial Sequence
  Synthetic
gccaagcatttaggtgacactataggctgccaatcctcagaaagtgtttcagagctatgctggaaacagc

SEQ ID NO: 59184 - DNA, 70 bp, Artificial Sequence
  Synthetic
gccaagcatttaggtgacactatagtatcttgcttcatgatatccgtttcagagctatgctggaaacagc

SEQ ID NO: 59185 - DNA, 70 bp, Artificial Sequence
  Synthetic
gccaagcatttaggtgacactatagaacccccagaaagtgggatggtttcagagctatgctggaaacagc

SEQ ID NO: 59186 - DNA, 70 bp, Artificial Sequence
  Synthetic
gccaagcatttaggtgacactatagttccagtctggatcctagaagtttcagagctatgctggaaacagc

SEQ ID NO: 59187 - DNA, 70 bp, Artificial Sequence
  Synthetic
gccaagcatttaggtgacactatagaatagaaatgaacacctctggtttcagagctatgctggaaacagc

SEQ ID NO: 59188 - DNA, 70 bp, Artificial Sequence
  Synthetic
gccaagcatttaggtgacactatagagtaaccagaacaactcatagtttcagagctatgctggaaacagc

SEQ ID NO: 59189 - DNA, 70 bp, Artificial Sequence
  Synthetic
gccaagcatttaggtgacactatagggtgaggctagaaattctctgtttcagagctatgctggaaacagc

SEQ ID NO: 59190 - DNA, 70 bp, Artificial Sequence
  Synthetic
gccaagcatttaggtgacactatagattagggctgatctccctgcgtttcagagctatgctggaaacagc

SEQ ID NO: 59191 - DNA, 70 bp, Artificial Sequence
  Synthetic
gccaagcatttaggtgacactatagtcgcgctcactgctccgtcggtttcagagctatgctggaaacagc

SEQ ID NO: 59192 - DNA, 70 bp, Artificial Sequence
  Synthetic
gccaagcatttaggtgacactatagtgattcctgagttctcttatgtttcagagctatgctggaaacagc

SEQ ID NO: 59193 - DNA, 70 bp, Artificial Sequence
  Synthetic
gccaagcatttaggtgacactatagacaggtgctcttacggaagtgtttcagagctatgctggaaacagc

SEQ ID NO: 59194 - DNA, 70 bp, Artificial Sequence
  Synthetic
gccaagcatttaggtgacactatagagccagcgtggcctgtgagggtttcagagctatgctggaaacagc

SEQ ID NO: 59195 - DNA, 70 bp, Artificial Sequence
  Synthetic
gccaagcatttaggtgacactatagctgccgcggaagggggactggtttcagagctatgctggaaacagc

SEQ ID NO: 59196 - DNA, 70 bp, Artificial Sequence
  Synthetic
gccaagcatttaggtgacactatagcttcagtgccggggcattatgtttcagagctatgctggaaacagc

SEQ ID NO: 59197 - DNA, 70 bp, Artificial Sequence
  Synthetic
gccaagcatttaggtgacactatagctggagcgcaaggaggactggtttcagagctatgctggaaacagc

SEQ ID NO: 59198 - DNA, 70 bp, Artificial Sequence
  Synthetic
gccaagcatttaggtgacactatagcatggaagctgtcttgaactgtttcagagctatgctggaaacagc

SEQ ID NO: 59199 - DNA, 70 bp, Artificial Sequence
  Synthetic
gccaagcatttaggtgacactatagcagttcatttccagcaggaagtttcagagctatgctggaaacagc

SEQ ID NO: 59200 - DNA, 70 bp, Artificial Sequence
  Synthetic
gccaagcatttaggtgacactatagaggagaggtccgggctcagggtttcagagctatgctggaaacagc

SEQ ID NO: 59201 - DNA, 70 bp, Artificial Sequence
  Synthetic
gccaagcatttaggtgacactatagccagctgataacttgccgcggtttcagagctatgctggaaacagc

SEQ ID NO: 59202 - DNA, 70 bp, Artificial Sequence
  Synthetic
gccaagcatttaggtgacactatagagaacttccgcagcatattggtttcagagctatgctggaaacagc

SEQ ID NO: 59203 - DNA, 70 bp, Artificial Sequence
  Synthetic
gccaagcatttaggtgacactatagacaaaggaacagagcgcgaagtttcagagctatgctggaaacagc

SEQ ID NO: 59204 - DNA, 70 bp, Artificial Sequence
  Synthetic
gccaagcatttaggtgacactatagacttcttgcccaacaatggggtttcagagctatgctggaaacagc

SEQ ID NO: 59205 - DNA, 70 bp, Artificial Sequence
  Synthetic
gccaagcatttaggtgacactatagcatctttgttctcgagtaccgtttcagagctatgctggaaacagc

SEQ ID NO: 59206 - DNA, 70 bp, Artificial Sequence
  Synthetic
gccaagcatttaggtgacactatagaaaccaaagtctcttctgctgtttcagagctatgctggaaacagc

SEQ ID NO: 59207 - DNA, 70 bp, Artificial Sequence
  Synthetic
gccaagcatttaggtgacactatagccgcctgcactgccatgaccgtttcagagctatgctggaaacagc

SEQ ID NO: 59208 - DNA, 70 bp, Artificial Sequence
  Synthetic
gccaagcatttaggtgacactatagggagggactccaagagacgcgtttcagagctatgctggaaacagc

SEQ ID NO: 59209 - DNA, 70 bp, Artificial Sequence
  Synthetic
gccaagcatttaggtgacactataggcacctcaggattcacactggtttcagagctatgctggaaacagc

SEQ ID NO: 59210 - DNA, 70 bp, Artificial Sequence
  Synthetic
gccaagcatttaggtgacactatagtggctgcccctcaacgctttgtttcagagctatgctggaaacagc

SEQ ID NO: 59211 - DNA, 70 bp, Artificial Sequence
  Synthetic
gccaagcatttaggtgacactataggcccctcaccattccagcctgtttcagagctatgctggaaacagc

SEQ ID NO: 59212 - DNA, 70 bp, Artificial Sequence
  Synthetic
gccaagcatttaggtgacactatagaccccaacaggaattagtgagtttcagagctatgctggaaacagc

SEQ ID NO: 59213 - DNA, 70 bp, Artificial Sequence
  Synthetic
gccaagcatttaggtgacactataggagcagacctatgacttcttgtttcagagctatgctggaaacagc

SEQ ID NO: 59214 - DNA, 70 bp, Artificial Sequence
  Synthetic
gccaagcatttaggtgacactatagttttccttcagcaaggacaagtttcagagctatgctggaaacagc

SEQ ID NO: 59215 - DNA, 70 bp, Artificial Sequence
  Synthetic
gccaagcatttaggtgacactatagcgtcaccctcaagccctcacgtttcagagctatgctggaaacagc

SEQ ID NO: 59216 - DNA, 70 bp, Artificial Sequence
  Synthetic
gccaagcatttaggtgacactatagcttcgagctgaggggacatcgtttcagagctatgctggaaacagc

SEQ ID NO: 59217 - DNA, 70 bp, Artificial Sequence
  Synthetic
gccaagcatttaggtgacactataggactctcccatgttataggagtttcagagctatgctggaaacagc

SEQ ID NO: 59218 - DNA, 70 bp, Artificial Sequence
  Synthetic
gccaagcatttaggtgacactatagggggagtgagcagacacactgtttcagagctatgctggaaacagc

SEQ ID NO: 59219 - DNA, 70 bp, Artificial Sequence
  Synthetic
gccaagcatttaggtgacactatagagcgttgcggcggcgggcaggtttcagagctatgctggaaacagc

SEQ ID NO: 59220 - DNA, 70 bp, Artificial Sequence
  Synthetic
gccaagcatttaggtgacactataggggagtgagcagacacactcgtttcagagctatgctggaaacagc

SEQ ID NO: 59221 - DNA, 70 bp, Artificial Sequence
  Synthetic
gccaagcatttaggtgacactatagtcagctcaacctccgcctctgtttcagagctatgctggaaacagc

SEQ ID NO: 59222 - DNA, 70 bp, Artificial Sequence
  Synthetic
gccaagcatttaggtgacactataggttagtttgtttttggagcggtttcagagctatgctggaaacagc

SEQ ID NO: 59223 - DNA, 70 bp, Artificial Sequence
  Synthetic
gccaagcatttaggtgacactatagtacccgaacccaagaggcgggtttcagagctatgctggaaacagc

SEQ ID NO: 59224 - DNA, 70 bp, Artificial Sequence
  Synthetic
gccaagcatttaggtgacactatagcggatttattcttattgcccgtttcagagctatgctggaaacagc

SEQ ID NO: 59225 - DNA, 70 bp, Artificial Sequence
  Synthetic
gccaagcatttaggtgacactatagatgggagcaactggagcagtgtttcagagctatgctggaaacagc

SEQ ID NO: 59226 - DNA, 70 bp, Artificial Sequence
  Synthetic
gccaagcatttaggtgacactatagaaggatggaaacttggaagcgtttcagagctatgctggaaacagc

SEQ ID NO: 59227 - DNA, 70 bp, Artificial Sequence
  Synthetic
gccaagcatttaggtgacactataggggagagacagtcttctcaggtttcagagctatgctggaaacagc

SEQ ID NO: 59228 - DNA, 70 bp, Artificial Sequence
  Synthetic
gccaagcatttaggtgacactatagtgcagcctccccaggacctagtttcagagctatgctggaaacagc

SEQ ID NO: 59229 - DNA, 70 bp, Artificial Sequence
  Synthetic
gccaagcatttaggtgacactatagaagaggctattcaagatctcgtttcagagctatgctggaaacagc

SEQ ID NO: 59230 - DNA, 70 bp, Artificial Sequence
  Synthetic
gccaagcatttaggtgacactatagctaggtccttttggtgttttgtttcagagctatgctggaaacagc

SEQ ID NO: 59231 - DNA, 70 bp, Artificial Sequence
  Synthetic
gccaagcatttaggtgacactatagaagccaggattcaagaaatggtttcagagctatgctggaaacagc

SEQ ID NO: 59232 - DNA, 70 bp, Artificial Sequence
  Synthetic
gccaagcatttaggtgacactatagagggctcttgtctctaacgcgtttcagagctatgctggaaacagc

SEQ ID NO: 59233 - DNA, 70 bp, Artificial Sequence
  Synthetic
gccaagcatttaggtgacactatagctgccaaaaagcaggggggcgtttcagagctatgctggaaacagc

SEQ ID NO: 59234 - DNA, 70 bp, Artificial Sequence
  Synthetic
gccaagcatttaggtgacactataggttagcgttcttcagagcaggtttcagagctatgctggaaacagc

SEQ ID NO: 59235 - DNA, 70 bp, Artificial Sequence
  Synthetic
gccaagcatttaggtgacactataggactgggctgtaacagcttcgtttcagagctatgctggaaacagc

SEQ ID NO: 59236 - DNA, 70 bp, Artificial Sequence
  Synthetic
gccaagcatttaggtgacactatagagtgctgaggcggcattaaggtttcagagctatgctggaaacagc

SEQ ID NO: 59237 - DNA, 70 bp, Artificial Sequence
  Synthetic
gccaagcatttaggtgacactatagagcggcctgggatgttagtggtttcagagctatgctggaaacagc

SEQ ID NO: 59238 - DNA, 70 bp, Artificial Sequence
  Synthetic
gccaagcatttaggtgacactataggagaggaggcaggtcagcctgtttcagagctatgctggaaacagc

SEQ ID NO: 59239 - DNA, 70 bp, Artificial Sequence
  Synthetic
gccaagcatttaggtgacactatagtggaaagaatgggggtttacgtttcagagctatgctggaaacagc

SEQ ID NO: 59240 - DNA, 70 bp, Artificial Sequence
  Synthetic
gccaagcatttaggtgacactatagtactgaaaaatgggatctgagtttcagagctatgctggaaacagc

SEQ ID NO: 59241 - DNA, 70 bp, Artificial Sequence
  Synthetic
gccaagcatttaggtgacactatagatcatcatctgctggaagtggtttcagagctatgctggaaacagc

SEQ ID NO: 59242 - DNA, 70 bp, Artificial Sequence
  Synthetic
gccaagcatttaggtgacactatagcgccctccgcctgggctcaggtttcagagctatgctggaaacagc

SEQ ID NO: 59243 - DNA, 70 bp, Artificial Sequence
  Synthetic
gccaagcatttaggtgacactatagttcgcaatggagttggcacagtttcagagctatgctggaaacagc

SEQ ID NO: 59244 - DNA, 70 bp, Artificial Sequence
  Synthetic
gccaagcatttaggtgacactatagcagggtgagagctgtcacctgtttcagagctatgctggaaacagc

SEQ ID NO: 59245 - DNA, 70 bp, Artificial Sequence
  Synthetic
gccaagcatttaggtgacactatagcctagggtctagatgaattcgtttcagagctatgctggaaacagc

SEQ ID NO: 59246 - DNA, 70 bp, Artificial Sequence
  Synthetic
gccaagcatttaggtgacactatagcgttccgggagagaactgaggtttcagagctatgctggaaacagc

SEQ ID NO: 59247 - DNA, 70 bp, Artificial Sequence
  Synthetic
gccaagcatttaggtgacactatagtttgtgattgttggtagagtgtttcagagctatgctggaaacagc

SEQ ID NO: 59248 - DNA, 70 bp, Artificial Sequence
  Synthetic
gccaagcatttaggtgacactatagcctgccgtgctcagttgatcgtttcagagctatgctggaaacagc

SEQ ID NO: 59249 - DNA, 70 bp, Artificial Sequence
  Synthetic
gccaagcatttaggtgacactataggagaaggcggctacaagtcagtttcagagctatgctggaaacagc

SEQ ID NO: 59250 - DNA, 70 bp, Artificial Sequence
  Synthetic
gccaagcatttaggtgacactatagggggagggccaaggcatgaggtttcagagctatgctggaaacagc

SEQ ID NO: 59251 - DNA, 70 bp, Artificial Sequence
  Synthetic
gccaagcatttaggtgacactatagatcccgatcaaaaacagtcagtttcagagctatgctggaaacagc

SEQ ID NO: 59252 - DNA, 70 bp, Artificial Sequence
  Synthetic
gccaagcatttaggtgacactatagggcgggggacgctgtcagaagtttcagagctatgctggaaacagc

SEQ ID NO: 59253 - DNA, 70 bp, Artificial Sequence
  Synthetic
gccaagcatttaggtgacactatagagaccctgcaatgtggtgatgtttcagagctatgctggaaacagc

SEQ ID NO: 59254 - DNA, 70 bp, Artificial Sequence
  Synthetic
gccaagcatttaggtgacactatagtgcttgcttcaaagaagtttgtttcagagctatgctggaaacagc

SEQ ID NO: 59255 - DNA, 70 bp, Artificial Sequence
  Synthetic
gccaagcatttaggtgacactatagacagaggctaccaatgtctagtttcagagctatgctggaaacagc

SEQ ID NO: 59256 - DNA, 70 bp, Artificial Sequence
  Synthetic
gccaagcatttaggtgacactatagaggtccaatcccatttaaccgtttcagagctatgctggaaacagc

SEQ ID NO: 59257 - DNA, 70 bp, Artificial Sequence
  Synthetic
gccaagcatttaggtgacactataggccactacaccttttccatggtttcagagctatgctggaaacagc

SEQ ID NO: 59258 - DNA, 70 bp, Artificial Sequence
  Synthetic
gccaagcatttaggtgacactataggctttgatctggttgtcagtgtttcagagctatgctggaaacagc

SEQ ID NO: 59259 - DNA, 70 bp, Artificial Sequence
  Synthetic
gccaagcatttaggtgacactataggcacagcccactggcacttcgtttcagagctatgctggaaacagc

SEQ ID NO: 59260 - DNA, 70 bp, Artificial Sequence
  Synthetic
gccaagcatttaggtgacactatagcagcatggatgatatgatgcgtttcagagctatgctggaaacagc

SEQ ID NO: 59261 - DNA, 70 bp, Artificial Sequence
  Synthetic
gccaagcatttaggtgacactatagttggggacatgcttttgctcgtttcagagctatgctggaaacagc

SEQ ID NO: 59262 - DNA, 70 bp, Artificial Sequence
  Synthetic
gccaagcatttaggtgacactatagaggccggccgggcgggtcacgtttcagagctatgctggaaacagc

SEQ ID NO: 59263 - DNA, 70 bp, Artificial Sequence
  Synthetic
gccaagcatttaggtgacactataggcctttaaagttcacccttagtttcagagctatgctggaaacagc

SEQ ID NO: 59264 - DNA, 70 bp, Artificial Sequence
  Synthetic
gccaagcatttaggtgacactatagctgggacgtccacgagtgaggtttcagagctatgctggaaacagc

SEQ ID NO: 59265 - DNA, 70 bp, Artificial Sequence
  Synthetic
gccaagcatttaggtgacactatagaccgctgctctctgagatctgtttcagagctatgctggaaacagc

SEQ ID NO: 59266 - DNA, 70 bp, Artificial Sequence
  Synthetic
gccaagcatttaggtgacactatagatctgggacgtgcagtgatggtttcagagctatgctggaaacagc

SEQ ID NO: 59267 - DNA, 70 bp, Artificial Sequence
  Synthetic
gccaagcatttaggtgacactatagcggcatcacaggtagctgaggtttcagagctatgctggaaacagc

SEQ ID NO: 59268 - DNA, 70 bp, Artificial Sequence
  Synthetic
gccaagcatttaggtgacactatagctccaggagatctgcagctggtttcagagctatgctggaaacagc

SEQ ID NO: 59269 - DNA, 70 bp, Artificial Sequence
  Synthetic
gccaagcatttaggtgacactatagtagtctttcattgcaaccacgtttcagagctatgctggaaacagc

SEQ ID NO: 59270 - DNA, 70 bp, Artificial Sequence
  Synthetic
gccaagcatttaggtgacactatagcattcatcacttgccagcacgtttcagagctatgctggaaacagc

SEQ ID NO: 59271 - DNA, 70 bp, Artificial Sequence
  Synthetic
gccaagcatttaggtgacactatagctcgtcttgtgaaatgaatggtttcagagctatgctggaaacagc

SEQ ID NO: 59272 - DNA, 70 bp, Artificial Sequence
  Synthetic
gccaagcatttaggtgacactataggcattcatcagtcttaaagcgtttcagagctatgctggaaacagc

SEQ ID NO: 59273 - DNA, 70 bp, Artificial Sequence
  Synthetic
gccaagcatttaggtgacactataggtgtggtttgcgctatagacgtttcagagctatgctggaaacagc

SEQ ID NO: 59274 - DNA, 70 bp, Artificial Sequence
  Synthetic
gccaagcatttaggtgacactatagcctgcgggtgcttggggagagtttcagagctatgctggaaacagc

SEQ ID NO: 59275 - DNA, 70 bp, Artificial Sequence
  Synthetic
gccaagcatttaggtgacactatagtacaaacttaggggaagttggtttcagagctatgctggaaacagc

SEQ ID NO: 59276 - DNA, 70 bp, Artificial Sequence
  Synthetic
gccaagcatttaggtgacactatagcttgtgagcttagatatcacgtttcagagctatgctggaaacagc

SEQ ID NO: 59277 - DNA, 70 bp, Artificial Sequence
  Synthetic
gccaagcatttaggtgacactatagcgcatgctcaggtcacctcagtttcagagctatgctggaaacagc

SEQ ID NO: 59278 - DNA, 70 bp, Artificial Sequence
  Synthetic
gccaagcatttaggtgacactatagtcacaaaggagcttctccatgtttcagagctatgctggaaacagc

SEQ ID NO: 59279 - DNA, 70 bp, Artificial Sequence
  Synthetic
gccaagcatttaggtgacactatagcgcccaaggtctaggagcacgtttcagagctatgctggaaacagc

SEQ ID NO: 59280 - DNA, 70 bp, Artificial Sequence
  Synthetic
gccaagcatttaggtgacactatagcagttttaactggccgtatagtttcagagctatgctggaaacagc

SEQ ID NO: 59281 - DNA, 70 bp, Artificial Sequence
  Synthetic
gccaagcatttaggtgacactatagcgtggccccgtcatggtcacgtttcagagctatgctggaaacagc

SEQ ID NO: 59282 - DNA, 70 bp, Artificial Sequence
  Synthetic
gccaagcatttaggtgacactatagaatgtgtgagatgtgctttcgtttcagagctatgctggaaacagc

SEQ ID NO: 59283 - DNA, 70 bp, Artificial Sequence
  Synthetic
gccaagcatttaggtgacactatagatgatttcagctaacatctcgtttcagagctatgctggaaacagc

SEQ ID NO: 59284 - DNA, 70 bp, Artificial Sequence
  Synthetic
gccaagcatttaggtgacactatagtactgcttctctcttcaggtgtttcagagctatgctggaaacagc

SEQ ID NO: 59285 - DNA, 70 bp, Artificial Sequence
  Synthetic
gccaagcatttaggtgacactataggggcagcgggcagtcacttcgtttcagagctatgctggaaacagc

SEQ ID NO: 59286 - DNA, 70 bp, Artificial Sequence
  Synthetic
gccaagcatttaggtgacactataggttcccaggcaggggtcagagtttcagagctatgctggaaacagc

SEQ ID NO: 59287 - DNA, 70 bp, Artificial Sequence
  Synthetic
gccaagcatttaggtgacactatagcttgggaggaggtcttagaagtttcagagctatgctggaaacagc

SEQ ID NO: 59288 - DNA, 70 bp, Artificial Sequence
  Synthetic
gccaagcatttaggtgacactatagatgatcagggtctctatttagtttcagagctatgctggaaacagc

SEQ ID NO: 59289 - DNA, 70 bp, Artificial Sequence
  Synthetic
gccaagcatttaggtgacactataggacaccctacctttctaatcgtttcagagctatgctggaaacagc

SEQ ID NO: 59290 - DNA, 70 bp, Artificial Sequence
  Synthetic
gccaagcatttaggtgacactatagggcccaggctcaagtctgctgtttcagagctatgctggaaacagc

SEQ ID NO: 59291 - DNA, 70 bp, Artificial Sequence
  Synthetic
gccaagcatttaggtgacactatagtatagggcacatccccgttcgtttcagagctatgctggaaacagc

SEQ ID NO: 59292 - DNA, 70 bp, Artificial Sequence
  Synthetic
gccaagcatttaggtgacactatagctgcaagaccagtgtgggcagtttcagagctatgctggaaacagc

SEQ ID NO: 59293 - DNA, 70 bp, Artificial Sequence
  Synthetic
gccaagcatttaggtgacactatagtggacatggctcacaacagcgtttcagagctatgctggaaacagc

SEQ ID NO: 59294 - DNA, 70 bp, Artificial Sequence
  Synthetic
gccaagcatttaggtgacactatagggggtcccggcgggcatcacgtttcagagctatgctggaaacagc

SEQ ID NO: 59295 - DNA, 70 bp, Artificial Sequence
  Synthetic
gccaagcatttaggtgacactatagttgtatgggattgccatgtggtttcagagctatgctggaaacagc

SEQ ID NO: 59296 - DNA, 70 bp, Artificial Sequence
  Synthetic
gccaagcatttaggtgacactatagctctctgaggatattctgaagtttcagagctatgctggaaacagc

SEQ ID NO: 59297 - DNA, 70 bp, Artificial Sequence
  Synthetic
gccaagcatttaggtgacactatagtggcccgagtgagctctaaggtttcagagctatgctggaaacagc

SEQ ID NO: 59298 - DNA, 70 bp, Artificial Sequence
  Synthetic
gccaagcatttaggtgacactatagcgtgggacccaggcctgaccgtttcagagctatgctggaaacagc

SEQ ID NO: 59299 - DNA, 70 bp, Artificial Sequence
  Synthetic
gccaagcatttaggtgacactatagaaggaattcatggcgttgacgtttcagagctatgctggaaacagc

SEQ ID NO: 59300 - DNA, 70 bp, Artificial Sequence
  Synthetic
gccaagcatttaggtgacactatagctattttatggtaggggagagtttcagagctatgctggaaacagc

SEQ ID NO: 59301 - DNA, 70 bp, Artificial Sequence
  Synthetic
gccaagcatttaggtgacactatagggagctggagctgctgctgggtttcagagctatgctggaaacagc

SEQ ID NO: 59302 - DNA, 70 bp, Artificial Sequence
  Synthetic
gccaagcatttaggtgacactatagaagtggaggtaactgattctgtttcagagctatgctggaaacagc

SEQ ID NO: 59303 - DNA, 70 bp, Artificial Sequence
  Synthetic
gccaagcatttaggtgacactatagagctgtggaggtggtgacatgtttcagagctatgctggaaacagc

SEQ ID NO: 59304 - DNA, 70 bp, Artificial Sequence
  Synthetic
gccaagcatttaggtgacactatagaactgagcatgctcctattcgtttcagagctatgctggaaacagc

SEQ ID NO: 59305 - DNA, 70 bp, Artificial Sequence
  Synthetic
gccaagcatttaggtgacactatagcttagagaatgaagcccaaagtttcagagctatgctggaaacagc

SEQ ID NO: 59306 - DNA, 70 bp, Artificial Sequence
  Synthetic
gccaagcatttaggtgacactataggagactctcctcatagtgaagtttcagagctatgctggaaacagc

SEQ ID NO: 59307 - DNA, 70 bp, Artificial Sequence
  Synthetic
gccaagcatttaggtgacactatagttacttgcacaagtatctcggtttcagagctatgctggaaacagc

SEQ ID NO: 59308 - DNA, 70 bp, Artificial Sequence
  Synthetic
gccaagcatttaggtgacactatagtttatacagcaatagggtctgtttcagagctatgctggaaacagc

SEQ ID NO: 59309 - DNA, 70 bp, Artificial Sequence
  Synthetic
gccaagcatttaggtgacactatagcgcgcggcggggccctagaggtttcagagctatgctggaaacagc

SEQ ID NO: 59310 - DNA, 70 bp, Artificial Sequence
  Synthetic
gccaagcatttaggtgacactatagttcctacatctcaagtcactgtttcagagctatgctggaaacagc

SEQ ID NO: 59311 - DNA, 70 bp, Artificial Sequence
  Synthetic
gccaagcatttaggtgacactatagtggtactgctcgtctctaccgtttcagagctatgctggaaacagc

SEQ ID NO: 59312 - DNA, 70 bp, Artificial Sequence
  Synthetic
gccaagcatttaggtgacactatagcggcggccccagcggagactgtttcagagctatgctggaaacagc

SEQ ID NO: 59313 - DNA, 70 bp, Artificial Sequence
  Synthetic
gccaagcatttaggtgacactatagggagaagtttatggacttctgtttcagagctatgctggaaacagc

SEQ ID NO: 59314 - DNA, 70 bp, Artificial Sequence
  Synthetic
gccaagcatttaggtgacactatagctgactgagacagcagtcacgtttcagagctatgctggaaacagc

SEQ ID NO: 59315 - DNA, 70 bp, Artificial Sequence
  Synthetic
gccaagcatttaggtgacactatagaaagagactgtctccacaaagtttcagagctatgctggaaacagc

SEQ ID NO: 59316 - DNA, 70 bp, Artificial Sequence
  Synthetic
gccaagcatttaggtgacactatagcgggtttacttcatgacactgtttcagagctatgctggaaacagc

SEQ ID NO: 59317 - DNA, 70 bp, Artificial Sequence
  Synthetic
gccaagcatttaggtgacactatagaggtgctctgaacggctcaggtttcagagctatgctggaaacagc

SEQ ID NO: 59318 - DNA, 70 bp, Artificial Sequence
  Synthetic
gccaagcatttaggtgacactatagcaggatggggaggcagagtggtttcagagctatgctggaaacagc

SEQ ID NO: 59319 - DNA, 70 bp, Artificial Sequence
  Synthetic
gccaagcatttaggtgacactataggccctggccttgcaggtatggtttcagagctatgctggaaacagc

SEQ ID NO: 59320 - DNA, 70 bp, Artificial Sequence
  Synthetic
gccaagcatttaggtgacactatagtctacctgggcctggctcacgtttcagagctatgctggaaacagc

SEQ ID NO: 59321 - DNA, 70 bp, Artificial Sequence
  Synthetic
gccaagcatttaggtgacactataggagctggccccacgctcagagtttcagagctatgctggaaacagc

SEQ ID NO: 59322 - DNA, 70 bp, Artificial Sequence
  Synthetic
gccaagcatttaggtgacactatagaacccaacaagctaggccaggtttcagagctatgctggaaacagc

SEQ ID NO: 59323 - DNA, 70 bp, Artificial Sequence
  Synthetic
gccaagcatttaggtgacactatagttctgagagagcctgggggagtttcagagctatgctggaaacagc

SEQ ID NO: 59324 - DNA, 70 bp, Artificial Sequence
  Synthetic
gccaagcatttaggtgacactatagatagacagcaccatacaatcgtttcagagctatgctggaaacagc

SEQ ID NO: 59325 - DNA, 70 bp, Artificial Sequence
  Synthetic
gccaagcatttaggtgacactataggtacttattcggaggcatgagtttcagagctatgctggaaacagc

SEQ ID NO: 59326 - DNA, 70 bp, Artificial Sequence
  Synthetic
gccaagcatttaggtgacactatagagtgctgctccgaggcatgagtttcagagctatgctggaaacagc

SEQ ID NO: 59327 - DNA, 70 bp, Artificial Sequence
  Synthetic
gccaagcatttaggtgacactatagaccgtggctcgcactgctgagtttcagagctatgctggaaacagc

SEQ ID NO: 59328 - DNA, 70 bp, Artificial Sequence
  Synthetic
gccaagcatttaggtgacactatagtgttgagggtaacgttacaggtttcagagctatgctggaaacagc

SEQ ID NO: 59329 - DNA, 70 bp, Artificial Sequence
  Synthetic
gccaagcatttaggtgacactatagtggtcctccgtttactgaccgtttcagagctatgctggaaacagc

SEQ ID NO: 59330 - DNA, 70 bp, Artificial Sequence
  Synthetic
gccaagcatttaggtgacactatagaggtttcaggttgccagtaggtttcagagctatgctggaaacagc

SEQ ID NO: 59331 - DNA, 70 bp, Artificial Sequence
  Synthetic
gccaagcatttaggtgacactatagggcagctcaggagtccctctgtttcagagctatgctggaaacagc

SEQ ID NO: 59332 - DNA, 70 bp, Artificial Sequence
  Synthetic
gccaagcatttaggtgacactatagagtgaggtagggtcacacgcgtttcagagctatgctggaaacagc

SEQ ID NO: 59333 - DNA, 70 bp, Artificial Sequence
  Synthetic
gccaagcatttaggtgacactatagagaaaacactgaaagcagaggtttcagagctatgctggaaacagc

SEQ ID NO: 59334 - DNA, 70 bp, Artificial Sequence
  Synthetic
gccaagcatttaggtgacactatagcacctgatgatgggcgaccagtttcagagctatgctggaaacagc

SEQ ID NO: 59335 - DNA, 70 bp, Artificial Sequence
  Synthetic
gccaagcatttaggtgacactatagctccataacaactcagggttgtttcagagctatgctggaaacagc

SEQ ID NO: 59336 - DNA, 70 bp, Artificial Sequence
  Synthetic
gccaagcatttaggtgacactataggttggagcttttcgcactgcgtttcagagctatgctggaaacagc

SEQ ID NO: 59337 - DNA, 70 bp, Artificial Sequence
  Synthetic
gccaagcatttaggtgacactatagggccaagaagaacaaagacagtttcagagctatgctggaaacagc

SEQ ID NO: 59338 - DNA, 70 bp, Artificial Sequence
  Synthetic
gccaagcatttaggtgacactatagagaaacagaaaaacaaggacgtttcagagctatgctggaaacagc

SEQ ID NO: 59339 - DNA, 70 bp, Artificial Sequence
  Synthetic
gccaagcatttaggtgacactatagaccaacaatcctgaaaatgagtttcagagctatgctggaaacagc

SEQ ID NO: 59340 - DNA, 70 bp, Artificial Sequence
  Synthetic
gccaagcatttaggtgacactatagtgattctgcacacttgtgacgtttcagagctatgctggaaacagc

SEQ ID NO: 59341 - DNA, 70 bp, Artificial Sequence
  Synthetic
gccaagcatttaggtgacactatagtaagtgcagtacagagcagcgtttcagagctatgctggaaacagc

SEQ ID NO: 59342 - DNA, 70 bp, Artificial Sequence
  Synthetic
gccaagcatttaggtgacactatagggctggcggagagtcacagagtttcagagctatgctggaaacagc

SEQ ID NO: 59343 - DNA, 70 bp, Artificial Sequence
  Synthetic
gccaagcatttaggtgacactatagtgcatccttaactgagaatggtttcagagctatgctggaaacagc

SEQ ID NO: 59344 - DNA, 70 bp, Artificial Sequence
  Synthetic
gccaagcatttaggtgacactatagcgcagcgattgaggaaactggtttcagagctatgctggaaacagc

SEQ ID NO: 59345 - DNA, 70 bp, Artificial Sequence
  Synthetic
gccaagcatttaggtgacactatagaaatgggaatcacaagatcagtttcagagctatgctggaaacagc

SEQ ID NO: 59346 - DNA, 70 bp, Artificial Sequence
  Synthetic
gccaagcatttaggtgacactatagacctgcggagggtcaagtgagtttcagagctatgctggaaacagc

SEQ ID NO: 59347 - DNA, 70 bp, Artificial Sequence
  Synthetic
gccaagcatttaggtgacactatagttggccctcttaagagaagagtttcagagctatgctggaaacagc

SEQ ID NO: 59348 - DNA, 70 bp, Artificial Sequence
  Synthetic
gccaagcatttaggtgacactatagtcaatgctgtcatcgtgcaggtttcagagctatgctggaaacagc

SEQ ID NO: 59349 - DNA, 70 bp, Artificial Sequence
  Synthetic
gccaagcatttaggtgacactatagggctgagaagtcagcttagcgtttcagagctatgctggaaacagc

SEQ ID NO: 59350 - DNA, 70 bp, Artificial Sequence
  Synthetic
gccaagcatttaggtgacactatagtggctggggcaggcctctaggtttcagagctatgctggaaacagc

SEQ ID NO: 59351 - DNA, 70 bp, Artificial Sequence
  Synthetic
gccaagcatttaggtgacactatagactagctctaggggcagtttgtttcagagctatgctggaaacagc

SEQ ID NO: 59352 - DNA, 70 bp, Artificial Sequence
  Synthetic
gccaagcatttaggtgacactatagcagaggggaaacagtagcaagtttcagagctatgctggaaacagc

SEQ ID NO: 59353 - DNA, 70 bp, Artificial Sequence
  Synthetic
gccaagcatttaggtgacactatagtctccttgttcaattaatgcgtttcagagctatgctggaaacagc

SEQ ID NO: 59354 - DNA, 70 bp, Artificial Sequence
  Synthetic
gccaagcatttaggtgacactatagttaattttctttggccgcaagtttcagagctatgctggaaacagc

SEQ ID NO: 59355 - DNA, 70 bp, Artificial Sequence
  Synthetic
gccaagcatttaggtgacactatagtagcagtatcatcacaggaggtttcagagctatgctggaaacagc

SEQ ID NO: 59356 - DNA, 70 bp, Artificial Sequence
  Synthetic
gccaagcatttaggtgacactataggcacgatggctaatgctgccgtttcagagctatgctggaaacagc

SEQ ID NO: 59357 - DNA, 70 bp, Artificial Sequence
  Synthetic
gccaagcatttaggtgacactatagggcaggtggcttttcctactgtttcagagctatgctggaaacagc

SEQ ID NO: 59358 - DNA, 70 bp, Artificial Sequence
  Synthetic
gccaagcatttaggtgacactatagtggttcggctttttgaaattgtttcagagctatgctggaaacagc

SEQ ID NO: 59359 - DNA, 70 bp, Artificial Sequence
  Synthetic
gccaagcatttaggtgacactatagcccagctccatcctcttgaagtttcagagctatgctggaaacagc

SEQ ID NO: 59360 - DNA, 70 bp, Artificial Sequence
  Synthetic
gccaagcatttaggtgacactatagttcagctagcatcaagcactgtttcagagctatgctggaaacagc

SEQ ID NO: 59361 - DNA, 70 bp, Artificial Sequence
  Synthetic
gccaagcatttaggtgacactatagcggaggcctctgcccctcacgtttcagagctatgctggaaacagc

SEQ ID NO: 59362 - DNA, 70 bp, Artificial Sequence
  Synthetic
gccaagcatttaggtgacactatagcttggccaggcagatggcgcgtttcagagctatgctggaaacagc

SEQ ID NO: 59363 - DNA, 70 bp, Artificial Sequence
  Synthetic
gccaagcatttaggtgacactataggtccatccaccccggtgagcgtttcagagctatgctggaaacagc

SEQ ID NO: 59364 - DNA, 70 bp, Artificial Sequence
  Synthetic
gccaagcatttaggtgacactatagaatcatggagcacaggaaaagtttcagagctatgctggaaacagc

SEQ ID NO: 59365 - DNA, 70 bp, Artificial Sequence
  Synthetic
gccaagcatttaggtgacactatagtgtacttctgcaaaatgcgtgtttcagagctatgctggaaacagc

SEQ ID NO: 59366 - DNA, 70 bp, Artificial Sequence
  Synthetic
gccaagcatttaggtgacactatagacgcccccactcactcacctgtttcagagctatgctggaaacagc

SEQ ID NO: 59367 - DNA, 70 bp, Artificial Sequence
  Synthetic
gccaagcatttaggtgacactatagccaccaggaaggagtcagccgtttcagagctatgctggaaacagc

SEQ ID NO: 59368 - DNA, 70 bp, Artificial Sequence
  Synthetic
gccaagcatttaggtgacactatagcggagcctctgctatgtgcagtttcagagctatgctggaaacagc

SEQ ID NO: 59369 - DNA, 70 bp, Artificial Sequence
  Synthetic
gccaagcatttaggtgacactatagctggctaataaggactctatgtttcagagctatgctggaaacagc

SEQ ID NO: 59370 - DNA, 70 bp, Artificial Sequence
  Synthetic
gccaagcatttaggtgacactatagtactcaggcctcctcggcgagtttcagagctatgctggaaacagc

SEQ ID NO: 59371 - DNA, 70 bp, Artificial Sequence
  Synthetic
gccaagcatttaggtgacactatagttcacagacactgtctcagagtttcagagctatgctggaaacagc

SEQ ID NO: 59372 - DNA, 70 bp, Artificial Sequence
  Synthetic
gccaagcatttaggtgacactataggctgcgcagcgggaatgagcgtttcagagctatgctggaaacagc

SEQ ID NO: 59373 - DNA, 70 bp, Artificial Sequence
  Synthetic
gccaagcatttaggtgacactataggcggactgcacctgcaaagcgtttcagagctatgctggaaacagc

SEQ ID NO: 59374 - DNA, 70 bp, Artificial Sequence
  Synthetic
gccaagcatttaggtgacactatagttaggttccatcgcagcttagtttcagagctatgctggaaacagc

SEQ ID NO: 59375 - DNA, 70 bp, Artificial Sequence
  Synthetic
gccaagcatttaggtgacactatagttgatcaagacatccagcctgtttcagagctatgctggaaacagc

SEQ ID NO: 59376 - DNA, 70 bp, Artificial Sequence
  Synthetic
gccaagcatttaggtgacactataggaggaggaggaagaataagggtttcagagctatgctggaaacagc

SEQ ID NO: 59377 - DNA, 70 bp, Artificial Sequence
  Synthetic
gccaagcatttaggtgacactatagtttcagaatgtgctcaacatgtttcagagctatgctggaaacagc

SEQ ID NO: 59378 - DNA, 70 bp, Artificial Sequence
  Synthetic
gccaagcatttaggtgacactataggctggagcctgcgccttcaggtttcagagctatgctggaaacagc

SEQ ID NO: 59379 - DNA, 70 bp, Artificial Sequence
  Synthetic
gccaagcatttaggtgacactatagtcatcacttgataagaccaggtttcagagctatgctggaaacagc

SEQ ID NO: 59380 - DNA, 70 bp, Artificial Sequence
  Synthetic
gccaagcatttaggtgacactataggacaataaaggtgccctcaggtttcagagctatgctggaaacagc

SEQ ID NO: 59381 - DNA, 70 bp, Artificial Sequence
  Synthetic
gccaagcatttaggtgacactatagagtttttgcccttggctactgtttcagagctatgctggaaacagc

SEQ ID NO: 59382 - DNA, 70 bp, Artificial Sequence
  Synthetic
gccaagcatttaggtgacactatagcacttccttggaatcctagagtttcagagctatgctggaaacagc

SEQ ID NO: 59383 - DNA, 70 bp, Artificial Sequence
  Synthetic
gccaagcatttaggtgacactatagtccacaggaagtcactgccagtttcagagctatgctggaaacagc

SEQ ID NO: 59384 - DNA, 70 bp, Artificial Sequence
  Synthetic
gccaagcatttaggtgacactatagagcaagcggccctgctgagcgtttcagagctatgctggaaacagc

SEQ ID NO: 59385 - DNA, 70 bp, Artificial Sequence
  Synthetic
gccaagcatttaggtgacactatagtgggaaaagatctcttctccgtttcagagctatgctggaaacagc

SEQ ID NO: 59386 - DNA, 70 bp, Artificial Sequence
  Synthetic
gccaagcatttaggtgacactatagtgtgccttgtcgagaaaaatgtttcagagctatgctggaaacagc

SEQ ID NO: 59387 - DNA, 70 bp, Artificial Sequence
  Synthetic
gccaagcatttaggtgacactatagctgggcatgggtctcaggccgtttcagagctatgctggaaacagc

SEQ ID NO: 59388 - DNA, 70 bp, Artificial Sequence
  Synthetic
gccaagcatttaggtgacactatagcggccgcccagggtctctgagtttcagagctatgctggaaacagc

SEQ ID NO: 59389 - DNA, 70 bp, Artificial Sequence
  Synthetic
gccaagcatttaggtgacactatagagcaggtgcaagaccagaaggtttcagagctatgctggaaacagc

SEQ ID NO: 59390 - DNA, 70 bp, Artificial Sequence
  Synthetic
gccaagcatttaggtgacactatagggtgagactgtgctctgagcgtttcagagctatgctggaaacagc

SEQ ID NO: 59391 - DNA, 70 bp, Artificial Sequence
  Synthetic
gccaagcatttaggtgacactatagagctttgccctgagatgagcgtttcagagctatgctggaaacagc

SEQ ID NO: 59392 - DNA, 70 bp, Artificial Sequence
  Synthetic
gccaagcatttaggtgacactatagcgtccagaatcacgccctccgtttcagagctatgctggaaacagc

SEQ ID NO: 59393 - DNA, 70 bp, Artificial Sequence
  Synthetic
gccaagcatttaggtgacactataggaagaagggcaagtgcaagagtttcagagctatgctggaaacagc

SEQ ID NO: 59394 - DNA, 70 bp, Artificial Sequence
  Synthetic
gccaagcatttaggtgacactataggcccagccggcgggctcagggtttcagagctatgctggaaacagc

SEQ ID NO: 59395 - DNA, 70 bp, Artificial Sequence
  Synthetic
gccaagcatttaggtgacactatagttctcttggaagaaaagtcagtttcagagctatgctggaaacagc

SEQ ID NO: 59396 - DNA, 70 bp, Artificial Sequence
  Synthetic
gccaagcatttaggtgacactatagccatctcacgtctagtgctcgtttcagagctatgctggaaacagc

SEQ ID NO: 59397 - DNA, 70 bp, Artificial Sequence
  Synthetic
gccaagcatttaggtgacactatagcgccagccccctggtgttctgtttcagagctatgctggaaacagc

SEQ ID NO: 59398 - DNA, 70 bp, Artificial Sequence
  Synthetic
gccaagcatttaggtgacactataggtcctccgggcggggctcaggtttcagagctatgctggaaacagc

SEQ ID NO: 59399 - DNA, 70 bp, Artificial Sequence
  Synthetic
gccaagcatttaggtgacactataggtacagacaatccagcattagtttcagagctatgctggaaacagc

SEQ ID NO: 59400 - DNA, 70 bp, Artificial Sequence
  Synthetic
gccaagcatttaggtgacactatagtgacgtgcgtgcagagcagcgtttcagagctatgctggaaacagc

SEQ ID NO: 59401 - DNA, 70 bp, Artificial Sequence
  Synthetic
gccaagcatttaggtgacactatagcctggatgtcctgggctagggtttcagagctatgctggaaacagc

SEQ ID NO: 59402 - DNA, 70 bp, Artificial Sequence
  Synthetic
gccaagcatttaggtgacactatagaaattattatcaggcggtctgtttcagagctatgctggaaacagc

SEQ ID NO: 59403 - DNA, 70 bp, Artificial Sequence
  Synthetic
gccaagcatttaggtgacactatagtacctggacattctaggctagtttcagagctatgctggaaacagc

SEQ ID NO: 59404 - DNA, 70 bp, Artificial Sequence
  Synthetic
gccaagcatttaggtgacactatagttcataagatcccactggatgtttcagagctatgctggaaacagc

SEQ ID NO: 59405 - DNA, 70 bp, Artificial Sequence
  Synthetic
gccaagcatttaggtgacactatagctacagcacggattattacagtttcagagctatgctggaaacagc

SEQ ID NO: 59406 - DNA, 70 bp, Artificial Sequence
  Synthetic
gccaagcatttaggtgacactatagacctggacattcttggctaggtttcagagctatgctggaaacagc

SEQ ID NO: 59407 - DNA, 70 bp, Artificial Sequence
  Synthetic
gccaagcatttaggtgacactatagtatttcagcaaaggacgtcagtttcagagctatgctggaaacagc

SEQ ID NO: 59408 - DNA, 70 bp, Artificial Sequence
  Synthetic
gccaagcatttaggtgacactatagtttgagtatgtagggtcttcgtttcagagctatgctggaaacagc

SEQ ID NO: 59409 - DNA, 70 bp, Artificial Sequence
  Synthetic
gccaagcatttaggtgacactatagcacccgcgagacgctgtactgtttcagagctatgctggaaacagc

SEQ ID NO: 59410 - DNA, 70 bp, Artificial Sequence
  Synthetic
gccaagcatttaggtgacactatagtcttgcattacattcaggtcgtttcagagctatgctggaaacagc

SEQ ID NO: 59411 - DNA, 70 bp, Artificial Sequence
  Synthetic
gccaagcatttaggtgacactatagtcaggtctacaagcaagcgcgtttcagagctatgctggaaacagc

SEQ ID NO: 59412 - DNA, 70 bp, Artificial Sequence
  Synthetic
gccaagcatttaggtgacactatagctgctcaaagctcacctgaggtttcagagctatgctggaaacagc

SEQ ID NO: 59413 - DNA, 70 bp, Artificial Sequence
  Synthetic
gccaagcatttaggtgacactatagagactatcttgactcaactcgtttcagagctatgctggaaacagc

SEQ ID NO: 59414 - DNA, 70 bp, Artificial Sequence
  Synthetic
gccaagcatttaggtgacactatagtatacttctgtaggctaacggtttcagagctatgctggaaacagc

SEQ ID NO: 59415 - DNA, 70 bp, Artificial Sequence
  Synthetic
gccaagcatttaggtgacactatagtctcgtttcaggaactgatggtttcagagctatgctggaaacagc

SEQ ID NO: 59416 - DNA, 70 bp, Artificial Sequence
  Synthetic
gccaagcatttaggtgacactatagccgcgtgtccacacagttaggtttcagagctatgctggaaacagc

SEQ ID NO: 59417 - DNA, 70 bp, Artificial Sequence
  Synthetic
gccaagcatttaggtgacactatagtgcaaggtggccttagtcaggtttcagagctatgctggaaacagc

SEQ ID NO: 59418 - DNA, 70 bp, Artificial Sequence
  Synthetic
gccaagcatttaggtgacactatagcacttggggaatcattctgagtttcagagctatgctggaaacagc

SEQ ID NO: 59419 - DNA, 70 bp, Artificial Sequence
  Synthetic
gccaagcatttaggtgacactatagtcccggaggatcacagatgcgtttcagagctatgctggaaacagc

SEQ ID NO: 59420 - DNA, 70 bp, Artificial Sequence
  Synthetic
gccaagcatttaggtgacactatagtcaaacttcaattctccagcgtttcagagctatgctggaaacagc

SEQ ID NO: 59421 - DNA, 70 bp, Artificial Sequence
  Synthetic
gccaagcatttaggtgacactatagagatgaagccccttctgggggtttcagagctatgctggaaacagc

SEQ ID NO: 59422 - DNA, 70 bp, Artificial Sequence
  Synthetic
gccaagcatttaggtgacactataggggctagttgaatttagcctgtttcagagctatgctggaaacagc

SEQ ID NO: 59423 - DNA, 70 bp, Artificial Sequence
  Synthetic
gccaagcatttaggtgacactatagggaaggcaggcaagtaggacgtttcagagctatgctggaaacagc

SEQ ID NO: 59424 - DNA, 70 bp, Artificial Sequence
  Synthetic
gccaagcatttaggtgacactatagttctcaaggtttgagaaatcgtttcagagctatgctggaaacagc

SEQ ID NO: 59425 - DNA, 70 bp, Artificial Sequence
  Synthetic
gccaagcatttaggtgacactatagcattaaaactgcacagccccgtttcagagctatgctggaaacagc

SEQ ID NO: 59426 - DNA, 70 bp, Artificial Sequence
  Synthetic
gccaagcatttaggtgacactatagcgaggtggacacggtctagcgtttcagagctatgctggaaacagc

SEQ ID NO: 59427 - DNA, 70 bp, Artificial Sequence
  Synthetic
gccaagcatttaggtgacactatagctagggatcgctatctggcggtttcagagctatgctggaaacagc

SEQ ID NO: 59428 - DNA, 70 bp, Artificial Sequence
  Synthetic
gccaagcatttaggtgacactatagggatcgctatctggcgaggagtttcagagctatgctggaaacagc

SEQ ID NO: 59429 - DNA, 70 bp, Artificial Sequence
  Synthetic
gccaagcatttaggtgacactatagtgatgtgcaatagctcggctgtttcagagctatgctggaaacagc

SEQ ID NO: 59430 - DNA, 70 bp, Artificial Sequence
  Synthetic
gccaagcatttaggtgacactataggcaatcatgagtgagccactgtttcagagctatgctggaaacagc

SEQ ID NO: 59431 - DNA, 70 bp, Artificial Sequence
  Synthetic
gccaagcatttaggtgacactatagtcttccctgcctgcttagccgtttcagagctatgctggaaacagc

SEQ ID NO: 59432 - DNA, 70 bp, Artificial Sequence
  Synthetic
gccaagcatttaggtgacactatagctagaaccctggagtctcacgtttcagagctatgctggaaacagc

SEQ ID NO: 59433 - DNA, 70 bp, Artificial Sequence
  Synthetic
gccaagcatttaggtgacactatagtgcgccgggtcgccacatacgtttcagagctatgctggaaacagc

SEQ ID NO: 59434 - DNA, 70 bp, Artificial Sequence
  Synthetic
gccaagcatttaggtgacactatagcaaaggaaatcatctctagggtttcagagctatgctggaaacagc

SEQ ID NO: 59435 - DNA, 70 bp, Artificial Sequence
  Synthetic
gccaagcatttaggtgacactatagcaggagagcaagtggtctgggtttcagagctatgctggaaacagc

SEQ ID NO: 59436 - DNA, 70 bp, Artificial Sequence
  Synthetic
gccaagcatttaggtgacactatagtagggaacagcagagagacagtttcagagctatgctggaaacagc

SEQ ID NO: 59437 - DNA, 70 bp, Artificial Sequence
  Synthetic
gccaagcatttaggtgacactatagacgtgggaatgttttcttatgtttcagagctatgctggaaacagc

SEQ ID NO: 59438 - DNA, 70 bp, Artificial Sequence
  Synthetic
gccaagcatttaggtgacactatagagattccagctcatcactaggtttcagagctatgctggaaacagc

SEQ ID NO: 59439 - DNA, 70 bp, Artificial Sequence
  Synthetic
gccaagcatttaggtgacactatagcagctcaggcagccctcaaggtttcagagctatgctggaaacagc

SEQ ID NO: 59440 - DNA, 70 bp, Artificial Sequence
  Synthetic
gccaagcatttaggtgacactataggagcaacgccttcgtgagcagtttcagagctatgctggaaacagc

SEQ ID NO: 59441 - DNA, 70 bp, Artificial Sequence
  Synthetic
gccaagcatttaggtgacactatagcttcccccaaaccaggggtcgtttcagagctatgctggaaacagc

SEQ ID NO: 59442 - DNA, 70 bp, Artificial Sequence
  Synthetic
gccaagcatttaggtgacactataggtcccagtgaacagatagaggtttcagagctatgctggaaacagc

SEQ ID NO: 59443 - DNA, 70 bp, Artificial Sequence
  Synthetic
gccaagcatttaggtgacactatagaagcttaagcaccctacaaagtttcagagctatgctggaaacagc

SEQ ID NO: 59444 - DNA, 70 bp, Artificial Sequence
  Synthetic
gccaagcatttaggtgacactatagccagtcagctcaggcctctagtttcagagctatgctggaaacagc

SEQ ID NO: 59445 - DNA, 70 bp, Artificial Sequence
  Synthetic
gccaagcatttaggtgacactataggtctccctcagctgttgagcgtttcagagctatgctggaaacagc

SEQ ID NO: 59446 - DNA, 70 bp, Artificial Sequence
  Synthetic
gccaagcatttaggtgacactatagtttattattttcagagcggcgtttcagagctatgctggaaacagc

SEQ ID NO: 59447 - DNA, 70 bp, Artificial Sequence
  Synthetic
gccaagcatttaggtgacactatagtctgctcagagctcgatgtcgtttcagagctatgctggaaacagc

SEQ ID NO: 59448 - DNA, 70 bp, Artificial Sequence
  Synthetic
gccaagcatttaggtgacactatagtctctctatcttacactagagtttcagagctatgctggaaacagc

SEQ ID NO: 59449 - DNA, 70 bp, Artificial Sequence
  Synthetic
gccaagcatttaggtgacactatagttcaagaagggcacttcaaagtttcagagctatgctggaaacagc

SEQ ID NO: 59450 - DNA, 70 bp, Artificial Sequence
  Synthetic
gccaagcatttaggtgacactataggaacttccagcagtttacacgtttcagagctatgctggaaacagc

SEQ ID NO: 59451 - DNA, 70 bp, Artificial Sequence
  Synthetic
gccaagcatttaggtgacactatagctctgaagagttattcctgagtttcagagctatgctggaaacagc

SEQ ID NO: 59452 - DNA, 70 bp, Artificial Sequence
  Synthetic
gccaagcatttaggtgacactataggtgagctgggggatatgagggtttcagagctatgctggaaacagc

SEQ ID NO: 59453 - DNA, 70 bp, Artificial Sequence
  Synthetic
gccaagcatttaggtgacactatagtccactccaggactgaataagtttcagagctatgctggaaacagc

SEQ ID NO: 59454 - DNA, 70 bp, Artificial Sequence
  Synthetic
gccaagcatttaggtgacactatagagaccatcagctacaacgcagtttcagagctatgctggaaacagc

SEQ ID NO: 59455 - DNA, 70 bp, Artificial Sequence
  Synthetic
gccaagcatttaggtgacactatagagaagacagctgaactgaaggtttcagagctatgctggaaacagc

SEQ ID NO: 59456 - DNA, 70 bp, Artificial Sequence
  Synthetic
gccaagcatttaggtgacactatagatgtgattttgcagtgtgttgtttcagagctatgctggaaacagc

SEQ ID NO: 59457 - DNA, 70 bp, Artificial Sequence
  Synthetic
gccaagcatttaggtgacactatagtggatagtccagatcaatgagtttcagagctatgctggaaacagc

SEQ ID NO: 59458 - DNA, 70 bp, Artificial Sequence
  Synthetic
gccaagcatttaggtgacactatagcaggagttacagtgatgtccgtttcagagctatgctggaaacagc

SEQ ID NO: 59459 - DNA, 70 bp, Artificial Sequence
  Synthetic
gccaagcatttaggtgacactatagcacccctcgagccaagggcagtttcagagctatgctggaaacagc

SEQ ID NO: 59460 - DNA, 70 bp, Artificial Sequence
  Synthetic
gccaagcatttaggtgacactatagaaacgtcttctgtaagtcacgtttcagagctatgctggaaacagc

SEQ ID NO: 59461 - DNA, 70 bp, Artificial Sequence
  Synthetic
gccaagcatttaggtgacactatagcaatctcgaatgtcttttgcgtttcagagctatgctggaaacagc

SEQ ID NO: 59462 - DNA, 70 bp, Artificial Sequence
  Synthetic
gccaagcatttaggtgacactatagaccagggacttgacccattagtttcagagctatgctggaaacagc

SEQ ID NO: 59463 - DNA, 70 bp, Artificial Sequence
  Synthetic
gccaagcatttaggtgacactatagaacaaactcgaagtaaggatgtttcagagctatgctggaaacagc

SEQ ID NO: 59464 - DNA, 70 bp, Artificial Sequence
  Synthetic
gccaagcatttaggtgacactatagctgttagacgcaggaaataagtttcagagctatgctggaaacagc

SEQ ID NO: 59465 - DNA, 70 bp, Artificial Sequence
  Synthetic
gccaagcatttaggtgacactatagtagcagtacaagccatcactgtttcagagctatgctggaaacagc

SEQ ID NO: 59466 - DNA, 70 bp, Artificial Sequence
  Synthetic
gccaagcatttaggtgacactatagagctaccgcttaaaatgatcgtttcagagctatgctggaaacagc

SEQ ID NO: 59467 - DNA, 70 bp, Artificial Sequence
  Synthetic
gccaagcatttaggtgacactatagtatcgtcggaccttgtgattgtttcagagctatgctggaaacagc

SEQ ID NO: 59468 - DNA, 70 bp, Artificial Sequence
  Synthetic
gccaagcatttaggtgacactataggtccggcatatgcaaagatagtttcagagctatgctggaaacagc

SEQ ID NO: 59469 - DNA, 70 bp, Artificial Sequence
  Synthetic
gccaagcatttaggtgacactataggtggcctcttgaggatatcagtttcagagctatgctggaaacagc

SEQ ID NO: 59470 - DNA, 70 bp, Artificial Sequence
  Synthetic
gccaagcatttaggtgacactatagggaaccttcacgcggcctaggtttcagagctatgctggaaacagc

SEQ ID NO: 59471 - DNA, 70 bp, Artificial Sequence
  Synthetic
gccaagcatttaggtgacactataggtcggctgcaacattggttagtttcagagctatgctggaaacagc

SEQ ID NO: 59472 - DNA, 70 bp, Artificial Sequence
  Synthetic
gccaagcatttaggtgacactatagttggtggctggcgaagctgagtttcagagctatgctggaaacagc

SEQ ID NO: 59473 - DNA, 70 bp, Artificial Sequence
  Synthetic
gccaagcatttaggtgacactatagcaatggagtacatgtttggcgtttcagagctatgctggaaacagc

SEQ ID NO: 59474 - DNA, 70 bp, Artificial Sequence
  Synthetic
gccaagcatttaggtgacactatagagaccacaagctgttgttttgtttcagagctatgctggaaacagc

SEQ ID NO: 59475 - DNA, 70 bp, Artificial Sequence
  Synthetic
gccaagcatttaggtgacactatagttaggtccttgtcttgtttggtttcagagctatgctggaaacagc

SEQ ID NO: 59476 - DNA, 70 bp, Artificial Sequence
  Synthetic
gccaagcatttaggtgacactatagcaactcgtctgcatcctcgcgtttcagagctatgctggaaacagc

SEQ ID NO: 59477 - DNA, 70 bp, Artificial Sequence
  Synthetic
gccaagcatttaggtgacactataggaaaccatccacatcagagggtttcagagctatgctggaaacagc

SEQ ID NO: 59478 - DNA, 70 bp, Artificial Sequence
  Synthetic
gccaagcatttaggtgacactatagcctccagctggaaacaaaaggtttcagagctatgctggaaacagc

SEQ ID NO: 59479 - DNA, 70 bp, Artificial Sequence
  Synthetic
gccaagcatttaggtgacactatagggctgctgtcgctcagtcaagtttcagagctatgctggaaacagc

SEQ ID NO: 59480 - DNA, 70 bp, Artificial Sequence
  Synthetic
gccaagcatttaggtgacactatagcattcagaattctgcagatcgtttcagagctatgctggaaacagc

SEQ ID NO: 59481 - DNA, 70 bp, Artificial Sequence
  Synthetic
gccaagcatttaggtgacactatagataagagaaggctcactggagtttcagagctatgctggaaacagc

SEQ ID NO: 59482 - DNA, 70 bp, Artificial Sequence
  Synthetic
gccaagcatttaggtgacactataggggtgaacatataagggaaagtttcagagctatgctggaaacagc

SEQ ID NO: 59483 - DNA, 70 bp, Artificial Sequence
  Synthetic
gccaagcatttaggtgacactatagagcatggcacttaattcatggtttcagagctatgctggaaacagc

SEQ ID NO: 59484 - DNA, 70 bp, Artificial Sequence
  Synthetic
gccaagcatttaggtgacactataggcaaagtgcctggggctcacgtttcagagctatgctggaaacagc

SEQ ID NO: 59485 - DNA, 70 bp, Artificial Sequence
  Synthetic
gccaagcatttaggtgacactatagccacctcaggtagagaaaaagtttcagagctatgctggaaacagc

SEQ ID NO: 59486 - DNA, 70 bp, Artificial Sequence
  Synthetic
gccaagcatttaggtgacactatagacatttagaagttccagagggtttcagagctatgctggaaacagc

SEQ ID NO: 59487 - DNA, 70 bp, Artificial Sequence
  Synthetic
gccaagcatttaggtgacactatagagaggaagaagcgaggggcagtttcagagctatgctggaaacagc

SEQ ID NO: 59488 - DNA, 70 bp, Artificial Sequence
  Synthetic
gccaagcatttaggtgacactatagggtgaggcgagtgcgcatctgtttcagagctatgctggaaacagc

SEQ ID NO: 59489 - DNA, 70 bp, Artificial Sequence
  Synthetic
gccaagcatttaggtgacactatagaacagcgtctgggaaagtaggtttcagagctatgctggaaacagc

SEQ ID NO: 59490 - DNA, 70 bp, Artificial Sequence
  Synthetic
gccaagcatttaggtgacactatagaatgcgaaggggcctcatttgtttcagagctatgctggaaacagc

SEQ ID NO: 59491 - DNA, 70 bp, Artificial Sequence
  Synthetic
gccaagcatttaggtgacactatagaggctcgccctgcacaacttgtttcagagctatgctggaaacagc

SEQ ID NO: 59492 - DNA, 70 bp, Artificial Sequence
  Synthetic
gccaagcatttaggtgacactatagatggtcccgctgctccctacgtttcagagctatgctggaaacagc

SEQ ID NO: 59493 - DNA, 70 bp, Artificial Sequence
  Synthetic
gccaagcatttaggtgacactataggcctgctcagaagcccctacgtttcagagctatgctggaaacagc

SEQ ID NO: 59494 - DNA, 70 bp, Artificial Sequence
  Synthetic
gccaagcatttaggtgacactatagccagggactgacagatgctggtttcagagctatgctggaaacagc

SEQ ID NO: 59495 - DNA, 70 bp, Artificial Sequence
  Synthetic
gccaagcatttaggtgacactatagctggggactgacagatgctggtttcagagctatgctggaaacagc

SEQ ID NO: 59496 - DNA, 70 bp, Artificial Sequence
  Synthetic
gccaagcatttaggtgacactatagtgccccatggcggcccctacgtttcagagctatgctggaaacagc

SEQ ID NO: 59497 - DNA, 70 bp, Artificial Sequence
  Synthetic
gccaagcatttaggtgacactatagccggctgctggagacatcacgtttcagagctatgctggaaacagc

SEQ ID NO: 59498 - DNA, 70 bp, Artificial Sequence
  Synthetic
gccaagcatttaggtgacactatagggacaaactggactgtcagcgtttcagagctatgctggaaacagc

SEQ ID NO: 59499 - DNA, 70 bp, Artificial Sequence
  Synthetic
gccaagcatttaggtgacactatagttgatttggtttcatttcccgtttcagagctatgctggaaacagc

SEQ ID NO: 59500 - DNA, 70 bp, Artificial Sequence
  Synthetic
gccaagcatttaggtgacactatagagttatcaggggcatagctggtttcagagctatgctggaaacagc

SEQ ID NO: 59501 - DNA, 70 bp, Artificial Sequence
  Synthetic
gccaagcatttaggtgacactatagatgcattagctcagcctcccgtttcagagctatgctggaaacagc

SEQ ID NO: 59502 - DNA, 70 bp, Artificial Sequence
  Synthetic
gccaagcatttaggtgacactatagcacttcatgaatgccacttcgtttcagagctatgctggaaacagc

SEQ ID NO: 59503 - DNA, 70 bp, Artificial Sequence
  Synthetic
gccaagcatttaggtgacactataggatttgcttgaaggcctccggtttcagagctatgctggaaacagc

SEQ ID NO: 59504 - DNA, 70 bp, Artificial Sequence
  Synthetic
gccaagcatttaggtgacactatagagtcacactggttgttacgagtttcagagctatgctggaaacagc

SEQ ID NO: 59505 - DNA, 70 bp, Artificial Sequence
  Synthetic
gccaagcatttaggtgacactatagtccaaccccagtccttagaggtttcagagctatgctggaaacagc

SEQ ID NO: 59506 - DNA, 70 bp, Artificial Sequence
  Synthetic
gccaagcatttaggtgacactatagaaaccggagcccatctagcggtttcagagctatgctggaaacagc

SEQ ID NO: 59507 - DNA, 70 bp, Artificial Sequence
  Synthetic
gccaagcatttaggtgacactatagagcgggtcagaacagcccccgtttcagagctatgctggaaacagc

SEQ ID NO: 59508 - DNA, 70 bp, Artificial Sequence
  Synthetic
gccaagcatttaggtgacactatagcccagatgctcaggaggctagtttcagagctatgctggaaacagc

SEQ ID NO: 59509 - DNA, 70 bp, Artificial Sequence
  Synthetic
gccaagcatttaggtgacactatagcttccaggactgggtggagggtttcagagctatgctggaaacagc

SEQ ID NO: 59510 - DNA, 70 bp, Artificial Sequence
  Synthetic
gccaagcatttaggtgacactatagcacccacctgatcatgtgatgtttcagagctatgctggaaacagc

SEQ ID NO: 59511 - DNA, 70 bp, Artificial Sequence
  Synthetic
gccaagcatttaggtgacactatagttttgaatcacataatccgggtttcagagctatgctggaaacagc

SEQ ID NO: 59512 - DNA, 70 bp, Artificial Sequence
  Synthetic
gccaagcatttaggtgacactatagcaagacaggctaggtttccagtttcagagctatgctggaaacagc

SEQ ID NO: 59513 - DNA, 70 bp, Artificial Sequence
  Synthetic
gccaagcatttaggtgacactatagcacccacctcaacatgtagtgtttcagagctatgctggaaacagc

SEQ ID NO: 59514 - DNA, 70 bp, Artificial Sequence
  Synthetic
gccaagcatttaggtgacactatagcttactttccctcgggatgagtttcagagctatgctggaaacagc

SEQ ID NO: 59515 - DNA, 70 bp, Artificial Sequence
  Synthetic
gccaagcatttaggtgacactataggagaccccatacttatcttcgtttcagagctatgctggaaacagc

SEQ ID NO: 59516 - DNA, 70 bp, Artificial Sequence
  Synthetic
gccaagcatttaggtgacactatagtactacccatctgggtgaccgtttcagagctatgctggaaacagc

SEQ ID NO: 59517 - DNA, 70 bp, Artificial Sequence
  Synthetic
gccaagcatttaggtgacactatagggaggggcgctatccgaagtgtttcagagctatgctggaaacagc

SEQ ID NO: 59518 - DNA, 70 bp, Artificial Sequence
  Synthetic
gccaagcatttaggtgacactatagcaggactgggccagctagtggtttcagagctatgctggaaacagc

SEQ ID NO: 59519 - DNA, 70 bp, Artificial Sequence
  Synthetic
gccaagcatttaggtgacactatagattgcttccgttttcaagatgtttcagagctatgctggaaacagc

SEQ ID NO: 59520 - DNA, 70 bp, Artificial Sequence
  Synthetic
gccaagcatttaggtgacactatagtgggacaccgccatctgagggtttcagagctatgctggaaacagc

SEQ ID NO: 59521 - DNA, 70 bp, Artificial Sequence
  Synthetic
gccaagcatttaggtgacactatagcacaggaagtcaatcacgatgtttcagagctatgctggaaacagc

SEQ ID NO: 59522 - DNA, 70 bp, Artificial Sequence
  Synthetic
gccaagcatttaggtgacactatagaaggtcttggagcagtgagcgtttcagagctatgctggaaacagc

SEQ ID NO: 59523 - DNA, 70 bp, Artificial Sequence
  Synthetic
gccaagcatttaggtgacactatagggcctgcagatggactgaccgtttcagagctatgctggaaacagc

SEQ ID NO: 59524 - DNA, 70 bp, Artificial Sequence
  Synthetic
gccaagcatttaggtgacactataggatccctacccaggctaggggtttcagagctatgctggaaacagc

SEQ ID NO: 59525 - DNA, 70 bp, Artificial Sequence
  Synthetic
gccaagcatttaggtgacactataggatgatcgaggaggtatttggtttcagagctatgctggaaacagc

SEQ ID NO: 59526 - DNA, 70 bp, Artificial Sequence
  Synthetic
gccaagcatttaggtgacactatagtggctgttctgaagagagatgtttcagagctatgctggaaacagc

SEQ ID NO: 59527 - DNA, 70 bp, Artificial Sequence
  Synthetic
gccaagcatttaggtgacactatagtggtcttgatcgtctgcaatgtttcagagctatgctggaaacagc

SEQ ID NO: 59528 - DNA, 70 bp, Artificial Sequence
  Synthetic
gccaagcatttaggtgacactatagaccgcatgttcactaattatgtttcagagctatgctggaaacagc

SEQ ID NO: 59529 - DNA, 70 bp, Artificial Sequence
  Synthetic
gccaagcatttaggtgacactatagaggccaggagtcaggagaccgtttcagagctatgctggaaacagc

SEQ ID NO: 59530 - DNA, 70 bp, Artificial Sequence
  Synthetic
gccaagcatttaggtgacactatagcaagatgcactggcattcaggtttcagagctatgctggaaacagc

SEQ ID NO: 59531 - DNA, 70 bp, Artificial Sequence
  Synthetic
gccaagcatttaggtgacactataggctatatgtctcaagcttcagtttcagagctatgctggaaacagc

SEQ ID NO: 59532 - DNA, 70 bp, Artificial Sequence
  Synthetic
gccaagcatttaggtgacactatagattcaggattctatggcttcgtttcagagctatgctggaaacagc

SEQ ID NO: 59533 - DNA, 70 bp, Artificial Sequence
  Synthetic
gccaagcatttaggtgacactatagctatcccactcatggcctaggtttcagagctatgctggaaacagc

SEQ ID NO: 59534 - DNA, 70 bp, Artificial Sequence
  Synthetic
gccaagcatttaggtgacactatagtgccggtaaaagtcatctaagtttcagagctatgctggaaacagc

SEQ ID NO: 59535 - DNA, 70 bp, Artificial Sequence
  Synthetic
gccaagcatttaggtgacactatagcatccagccatggccagtgagtttcagagctatgctggaaacagc

SEQ ID NO: 59536 - DNA, 70 bp, Artificial Sequence
  Synthetic
gccaagcatttaggtgacactatagcatagcaacagtcctgtttcgtttcagagctatgctggaaacagc

SEQ ID NO: 59537 - DNA, 70 bp, Artificial Sequence
  Synthetic
gccaagcatttaggtgacactataggtctcccagagaaaactaacgtttcagagctatgctggaaacagc

SEQ ID NO: 59538 - DNA, 70 bp, Artificial Sequence
  Synthetic
gccaagcatttaggtgacactatagagaccatcttgtctttctgagtttcagagctatgctggaaacagc

SEQ ID NO: 59539 - DNA, 70 bp, Artificial Sequence
  Synthetic
gccaagcatttaggtgacactataggggcatcaggagcaccaccggtttcagagctatgctggaaacagc

SEQ ID NO: 59540 - DNA, 70 bp, Artificial Sequence
  Synthetic
gccaagcatttaggtgacactatagagggttgcctattgtgttctgtttcagagctatgctggaaacagc

SEQ ID NO: 59541 - DNA, 70 bp, Artificial Sequence
  Synthetic
gccaagcatttaggtgacactatagattccaacgctttgaggggcgtttcagagctatgctggaaacagc

SEQ ID NO: 59542 - DNA, 70 bp, Artificial Sequence
  Synthetic
gccaagcatttaggtgacactatagaagctgcgttctcgaacactgtttcagagctatgctggaaacagc

SEQ ID NO: 59543 - DNA, 70 bp, Artificial Sequence
  Synthetic
gccaagcatttaggtgacactataggctctttatttggagtcagggtttcagagctatgctggaaacagc

SEQ ID NO: 59544 - DNA, 70 bp, Artificial Sequence
  Synthetic
gccaagcatttaggtgacactatagaagctgcgttcccgaacactgtttcagagctatgctggaaacagc

SEQ ID NO: 59545 - DNA, 70 bp, Artificial Sequence
  Synthetic
gccaagcatttaggtgacactatagacctggcccaggtgcgctgagtttcagagctatgctggaaacagc

SEQ ID NO: 59546 - DNA, 70 bp, Artificial Sequence
  Synthetic
gccaagcatttaggtgacactatagagacagggatggggatgagggtttcagagctatgctggaaacagc

SEQ ID NO: 59547 - DNA, 70 bp, Artificial Sequence
  Synthetic
gccaagcatttaggtgacactatagcacacacggctgctggtagagtttcagagctatgctggaaacagc

SEQ ID NO: 59548 - DNA, 70 bp, Artificial Sequence
  Synthetic
gccaagcatttaggtgacactatagcccccatggcgacgaacagcgtttcagagctatgctggaaacagc

SEQ ID NO: 59549 - DNA, 70 bp, Artificial Sequence
  Synthetic
gccaagcatttaggtgacactatagggtgggtaatgcattaagaggtttcagagctatgctggaaacagc

SEQ ID NO: 59550 - DNA, 70 bp, Artificial Sequence
  Synthetic
gccaagcatttaggtgacactatagggcatctatcttccatgaaggtttcagagctatgctggaaacagc

SEQ ID NO: 59551 - DNA, 70 bp, Artificial Sequence
  Synthetic
gccaagcatttaggtgacactatagtggctcatgtggtggtgggagtttcagagctatgctggaaacagc

SEQ ID NO: 59552 - DNA, 70 bp, Artificial Sequence
  Synthetic
gccaagcatttaggtgacactatagcaggggcacttagaagtacagtttcagagctatgctggaaacagc

SEQ ID NO: 59553 - DNA, 70 bp, Artificial Sequence
  Synthetic
gccaagcatttaggtgacactatagatgaatgaatctgctcccacgtttcagagctatgctggaaacagc

SEQ ID NO: 59554 - DNA, 70 bp, Artificial Sequence
  Synthetic
gccaagcatttaggtgacactatagttcaagagaagtttctacctgtttcagagctatgctggaaacagc

SEQ ID NO: 59555 - DNA, 70 bp, Artificial Sequence
  Synthetic
gccaagcatttaggtgacactatagtttggcactctttcatgcatgtttcagagctatgctggaaacagc

SEQ ID NO: 59556 - DNA, 70 bp, Artificial Sequence
  Synthetic
gccaagcatttaggtgacactatagcacagaatttaggaagctgagtttcagagctatgctggaaacagc

SEQ ID NO: 59557 - DNA, 70 bp, Artificial Sequence
  Synthetic
gccaagcatttaggtgacactataggcactgcctccttacctgtggtttcagagctatgctggaaacagc

SEQ ID NO: 59558 - DNA, 70 bp, Artificial Sequence
  Synthetic
gccaagcatttaggtgacactataggtggtattatatggctatccgtttcagagctatgctggaaacagc

SEQ ID NO: 59559 - DNA, 70 bp, Artificial Sequence
  Synthetic
gccaagcatttaggtgacactatagtcacacatcaagaagatggtgtttcagagctatgctggaaacagc

SEQ ID NO: 59560 - DNA, 70 bp, Artificial Sequence
  Synthetic
gccaagcatttaggtgacactatagtttaagaatgcaccatttccgtttcagagctatgctggaaacagc

SEQ ID NO: 59561 - DNA, 70 bp, Artificial Sequence
  Synthetic
gccaagcatttaggtgacactatagcttgggagcgaagaagactagtttcagagctatgctggaaacagc

SEQ ID NO: 59562 - DNA, 70 bp, Artificial Sequence
  Synthetic
gccaagcatttaggtgacactataggcatgataggcctggataacgtttcagagctatgctggaaacagc

SEQ ID NO: 59563 - DNA, 70 bp, Artificial Sequence
  Synthetic
gccaagcatttaggtgacactatagcaacttcttatggttcccttgtttcagagctatgctggaaacagc

SEQ ID NO: 59564 - DNA, 70 bp, Artificial Sequence
  Synthetic
gccaagcatttaggtgacactatagtcatctgaggaaagctgagagtttcagagctatgctggaaacagc

SEQ ID NO: 59565 - DNA, 70 bp, Artificial Sequence
  Synthetic
gccaagcatttaggtgacactatagccacagagcagcctgtgcttgtttcagagctatgctggaaacagc

SEQ ID NO: 59566 - DNA, 70 bp, Artificial Sequence
  Synthetic
gccaagcatttaggtgacactataggtggaagccgattttcctgtgtttcagagctatgctggaaacagc

SEQ ID NO: 59567 - DNA, 70 bp, Artificial Sequence
  Synthetic
gccaagcatttaggtgacactatagcctgataagtggcctcaggcgtttcagagctatgctggaaacagc

SEQ ID NO: 59568 - DNA, 70 bp, Artificial Sequence
  Synthetic
gccaagcatttaggtgacactatagggggggcgtgcagctcatctgtttcagagctatgctggaaacagc

SEQ ID NO: 59569 - DNA, 70 bp, Artificial Sequence
  Synthetic
gccaagcatttaggtgacactatagaatagatttcatggagtctcgtttcagagctatgctggaaacagc

SEQ ID NO: 59570 - DNA, 70 bp, Artificial Sequence
  Synthetic
gccaagcatttaggtgacactatagctggaagctgctttagaagagtttcagagctatgctggaaacagc

SEQ ID NO: 59571 - DNA, 70 bp, Artificial Sequence
  Synthetic
gccaagcatttaggtgacactataggactcccctgctggttgatggtttcagagctatgctggaaacagc

SEQ ID NO: 59572 - DNA, 70 bp, Artificial Sequence
  Synthetic
gccaagcatttaggtgacactatagggcgggtcagttgtccgcgtgtttcagagctatgctggaaacagc

SEQ ID NO: 59573 - DNA, 70 bp, Artificial Sequence
  Synthetic
gccaagcatttaggtgacactataggtcatcgacattcgtgactggtttcagagctatgctggaaacagc

SEQ ID NO: 59574 - DNA, 70 bp, Artificial Sequence
  Synthetic
gccaagcatttaggtgacactataggctgcccggccgctgctgctgtttcagagctatgctggaaacagc

SEQ ID NO: 59575 - DNA, 70 bp, Artificial Sequence
  Synthetic
gccaagcatttaggtgacactatagagtcctggatcctgagcagagtttcagagctatgctggaaacagc

SEQ ID NO: 59576 - DNA, 70 bp, Artificial Sequence
  Synthetic
gccaagcatttaggtgacactatagatgaagaactagacgactctgtttcagagctatgctggaaacagc

SEQ ID NO: 59577 - DNA, 70 bp, Artificial Sequence
  Synthetic
gccaagcatttaggtgacactatagcccagggctctgggttatgtgtttcagagctatgctggaaacagc

SEQ ID NO: 59578 - DNA, 70 bp, Artificial Sequence
  Synthetic
gccaagcatttaggtgacactatagagaagttcttgaagacgtccgtttcagagctatgctggaaacagc

SEQ ID NO: 59579 - DNA, 70 bp, Artificial Sequence
  Synthetic
gccaagcatttaggtgacactatagctaaaatgtcttgccctcaagtttcagagctatgctggaaacagc

SEQ ID NO: 59580 - DNA, 70 bp, Artificial Sequence
  Synthetic
gccaagcatttaggtgacactatagcccaaacagaacaggtttctgtttcagagctatgctggaaacagc

SEQ ID NO: 59581 - DNA, 70 bp, Artificial Sequence
  Synthetic
gccaagcatttaggtgacactataggagcgcacatacatccaccggtttcagagctatgctggaaacagc

SEQ ID NO: 59582 - DNA, 70 bp, Artificial Sequence
  Synthetic
gccaagcatttaggtgacactataggggagagacacatgcgattcgtttcagagctatgctggaaacagc

SEQ ID NO: 59583 - DNA, 70 bp, Artificial Sequence
  Synthetic
gccaagcatttaggtgacactatagttggcccggctgctggctacgtttcagagctatgctggaaacagc

SEQ ID NO: 59584 - DNA, 70 bp, Artificial Sequence
  Synthetic
gccaagcatttaggtgacactataggccaagtctgggaagccttagtttcagagctatgctggaaacagc

SEQ ID NO: 59585 - DNA, 70 bp, Artificial Sequence
  Synthetic
gccaagcatttaggtgacactatagactgtactagtacaacatcagtttcagagctatgctggaaacagc

SEQ ID NO: 59586 - DNA, 70 bp, Artificial Sequence
  Synthetic
gccaagcatttaggtgacactatagaaagggccggaaggctagatgtttcagagctatgctggaaacagc

SEQ ID NO: 59587 - DNA, 70 bp, Artificial Sequence
  Synthetic
gccaagcatttaggtgacactatagctccttggcaatgcatttgagtttcagagctatgctggaaacagc

SEQ ID NO: 59588 - DNA, 70 bp, Artificial Sequence
  Synthetic
gccaagcatttaggtgacactataggaagtctgtaattcttcagggtttcagagctatgctggaaacagc

SEQ ID NO: 59589 - DNA, 70 bp, Artificial Sequence
  Synthetic
gccaagcatttaggtgacactataggatggggtgggggatattgagtttcagagctatgctggaaacagc

SEQ ID NO: 59590 - DNA, 70 bp, Artificial Sequence
  Synthetic
gccaagcatttaggtgacactatagggaggagaggaaacctaggggtttcagagctatgctggaaacagc

SEQ ID NO: 59591 - DNA, 70 bp, Artificial Sequence
  Synthetic
gccaagcatttaggtgacactatagttctcaaagtgctagtaagcgtttcagagctatgctggaaacagc

SEQ ID NO: 59592 - DNA, 70 bp, Artificial Sequence
  Synthetic
gccaagcatttaggtgacactatagaactgtttggatgctttcccgtttcagagctatgctggaaacagc

SEQ ID NO: 59593 - DNA, 70 bp, Artificial Sequence
  Synthetic
gccaagcatttaggtgacactataggctgactcagtgacttcaacgtttcagagctatgctggaaacagc

SEQ ID NO: 59594 - DNA, 70 bp, Artificial Sequence
  Synthetic
gccaagcatttaggtgacactatagttggtacaggatcagttttcgtttcagagctatgctggaaacagc

SEQ ID NO: 59595 - DNA, 70 bp, Artificial Sequence
  Synthetic
gccaagcatttaggtgacactatagcccgatccgcatcgactggggtttcagagctatgctggaaacagc

SEQ ID NO: 59596 - DNA, 70 bp, Artificial Sequence
  Synthetic
gccaagcatttaggtgacactatagtatttcttcttcggttgttggtttcagagctatgctggaaacagc

SEQ ID NO: 59597 - DNA, 70 bp, Artificial Sequence
  Synthetic
gccaagcatttaggtgacactatagttgattaatttctcgttcgcgtttcagagctatgctggaaacagc

SEQ ID NO: 59598 - DNA, 70 bp, Artificial Sequence
  Synthetic
gccaagcatttaggtgacactatagaggagggagctacaactcgtgtttcagagctatgctggaaacagc

SEQ ID NO: 59599 - DNA, 70 bp, Artificial Sequence
  Synthetic
gccaagcatttaggtgacactatagacacctggccaggcagtttagtttcagagctatgctggaaacagc

SEQ ID NO: 59600 - DNA, 70 bp, Artificial Sequence
  Synthetic
gccaagcatttaggtgacactataggagccacagcattggctcaggtttcagagctatgctggaaacagc

SEQ ID NO: 59601 - DNA, 70 bp, Artificial Sequence
  Synthetic
gccaagcatttaggtgacactatagcaagacagaggatgacacatgtttcagagctatgctggaaacagc

SEQ ID NO: 59602 - DNA, 70 bp, Artificial Sequence
  Synthetic
gccaagcatttaggtgacactatagctaactcctaaacagcttacgtttcagagctatgctggaaacagc

SEQ ID NO: 59603 - DNA, 70 bp, Artificial Sequence
  Synthetic
gccaagcatttaggtgacactataggctgtaatgcattacttcaggtttcagagctatgctggaaacagc

SEQ ID NO: 59604 - DNA, 70 bp, Artificial Sequence
  Synthetic
gccaagcatttaggtgacactatagcctccacttcgtggtctgaggtttcagagctatgctggaaacagc

SEQ ID NO: 59605 - DNA, 70 bp, Artificial Sequence
  Synthetic
gccaagcatttaggtgacactataggtggggacaagggtgtcagtgtttcagagctatgctggaaacagc

SEQ ID NO: 59606 - DNA, 70 bp, Artificial Sequence
  Synthetic
gccaagcatttaggtgacactatagaagaaagaggaggaggtttggtttcagagctatgctggaaacagc

SEQ ID NO: 59607 - DNA, 70 bp, Artificial Sequence
  Synthetic
gccaagcatttaggtgacactatagggcccaggcccgccctcactgtttcagagctatgctggaaacagc

SEQ ID NO: 59608 - DNA, 70 bp, Artificial Sequence
  Synthetic
gccaagcatttaggtgacactatagccggcgccagtcggctcactgtttcagagctatgctggaaacagc

SEQ ID NO: 59609 - DNA, 70 bp, Artificial Sequence
  Synthetic
gccaagcatttaggtgacactatagtgctcacttgagcaagtcctgtttcagagctatgctggaaacagc

SEQ ID NO: 59610 - DNA, 70 bp, Artificial Sequence
  Synthetic
gccaagcatttaggtgacactatagccaagagaagtgcttgtcttgtttcagagctatgctggaaacagc

SEQ ID NO: 59611 - DNA, 70 bp, Artificial Sequence
  Synthetic
gccaagcatttaggtgacactatagtacccatggctctgggaggagtttcagagctatgctggaaacagc

SEQ ID NO: 59612 - DNA, 70 bp, Artificial Sequence
  Synthetic
gccaagcatttaggtgacactatagttcaaattcactgtgctcttgtttcagagctatgctggaaacagc

SEQ ID NO: 59613 - DNA, 70 bp, Artificial Sequence
  Synthetic
gccaagcatttaggtgacactatagttgaatagtaatcgagggtcgtttcagagctatgctggaaacagc

SEQ ID NO: 59614 - DNA, 70 bp, Artificial Sequence
  Synthetic
gccaagcatttaggtgacactatagcagaacaagaaggagcagaagtttcagagctatgctggaaacagc

SEQ ID NO: 59615 - DNA, 70 bp, Artificial Sequence
  Synthetic
gccaagcatttaggtgacactatagtggtcatgctggctgtctgagtttcagagctatgctggaaacagc

SEQ ID NO: 59616 - DNA, 70 bp, Artificial Sequence
  Synthetic
gccaagcatttaggtgacactataggagctggttaaaaaccacgggtttcagagctatgctggaaacagc

SEQ ID NO: 59617 - DNA, 70 bp, Artificial Sequence
  Synthetic
gccaagcatttaggtgacactataggcacttgtaccaaagcatgagtttcagagctatgctggaaacagc

SEQ ID NO: 59618 - DNA, 70 bp, Artificial Sequence
  Synthetic
gccaagcatttaggtgacactataggcacgtgtaccaaagcatgagtttcagagctatgctggaaacagc

SEQ ID NO: 59619 - DNA, 70 bp, Artificial Sequence
  Synthetic
gccaagcatttaggtgacactatagcgccacggccactttctccagtttcagagctatgctggaaacagc

SEQ ID NO: 59620 - DNA, 70 bp, Artificial Sequence
  Synthetic
gccaagcatttaggtgacactatagactatgttgtcttaagcaacgtttcagagctatgctggaaacagc

SEQ ID NO: 59621 - DNA, 70 bp, Artificial Sequence
  Synthetic
gccaagcatttaggtgacactatagcctttagctcagagcaagttgtttcagagctatgctggaaacagc

SEQ ID NO: 59622 - DNA, 70 bp, Artificial Sequence
  Synthetic
gccaagcatttaggtgacactatagtttcattgaagctcttcatcgtttcagagctatgctggaaacagc

SEQ ID NO: 59623 - DNA, 70 bp, Artificial Sequence
  Synthetic
gccaagcatttaggtgacactataggccggcgtccgagaaatagggtttcagagctatgctggaaacagc

SEQ ID NO: 59624 - DNA, 70 bp, Artificial Sequence
  Synthetic
gccaagcatttaggtgacactatagagtgcctgcgtccaagaaatgtttcagagctatgctggaaacagc

SEQ ID NO: 59625 - DNA, 70 bp, Artificial Sequence
  Synthetic
gccaagcatttaggtgacactatagtcactttcactcccatgagggtttcagagctatgctggaaacagc

SEQ ID NO: 59626 - DNA, 70 bp, Artificial Sequence
  Synthetic
gccaagcatttaggtgacactatagtgactgagctgcatcattccgtttcagagctatgctggaaacagc

SEQ ID NO: 59627 - DNA, 70 bp, Artificial Sequence
  Synthetic
gccaagcatttaggtgacactatagtgatgaagaagtgggctaaggtttcagagctatgctggaaacagc

SEQ ID NO: 59628 - DNA, 70 bp, Artificial Sequence
  Synthetic
gccaagcatttaggtgacactatagcttcctggagatgaaagttggtttcagagctatgctggaaacagc

SEQ ID NO: 59629 - DNA, 70 bp, Artificial Sequence
  Synthetic
gccaagcatttaggtgacactatagtttattgcgggatcctcacagtttcagagctatgctggaaacagc

SEQ ID NO: 59630 - DNA, 70 bp, Artificial Sequence
  Synthetic
gccaagcatttaggtgacactataggtaggaggcagacctcatgcgtttcagagctatgctggaaacagc

SEQ ID NO: 59631 - DNA, 70 bp, Artificial Sequence
  Synthetic
gccaagcatttaggtgacactataggccaatattgggtcctcagtgtttcagagctatgctggaaacagc

SEQ ID NO: 59632 - DNA, 70 bp, Artificial Sequence
  Synthetic
gccaagcatttaggtgacactataggccattcttcattcctacaagtttcagagctatgctggaaacagc

SEQ ID NO: 59633 - DNA, 70 bp, Artificial Sequence
  Synthetic
gccaagcatttaggtgacactatagcagccaggaccccaggatgtgtttcagagctatgctggaaacagc

SEQ ID NO: 59634 - DNA, 70 bp, Artificial Sequence
  Synthetic
gccaagcatttaggtgacactatagcaggaagtcttctgctgtgcgtttcagagctatgctggaaacagc

SEQ ID NO: 59635 - DNA, 70 bp, Artificial Sequence
  Synthetic
gccaagcatttaggtgacactatagggtggcgctgccgcctgaccgtttcagagctatgctggaaacagc

SEQ ID NO: 59636 - DNA, 70 bp, Artificial Sequence
  Synthetic
gccaagcatttaggtgacactatagatctccacgactagtcatacgtttcagagctatgctggaaacagc

SEQ ID NO: 59637 - DNA, 70 bp, Artificial Sequence
  Synthetic
gccaagcatttaggtgacactataggtaccgcggcccgcatgactgtttcagagctatgctggaaacagc

SEQ ID NO: 59638 - DNA, 70 bp, Artificial Sequence
  Synthetic
gccaagcatttaggtgacactatagcccctccacggccaatacaggtttcagagctatgctggaaacagc

SEQ ID NO: 59639 - DNA, 70 bp, Artificial Sequence
  Synthetic
gccaagcatttaggtgacactatagaaagaagacagaaatctgacgtttcagagctatgctggaaacagc

SEQ ID NO: 59640 - DNA, 70 bp, Artificial Sequence
  Synthetic
gccaagcatttaggtgacactatagactgctccgttgccctaacagtttcagagctatgctggaaacagc

SEQ ID NO: 59641 - DNA, 70 bp, Artificial Sequence
  Synthetic
gccaagcatttaggtgacactatagactggcttttgagaaataaggtttcagagctatgctggaaacagc

SEQ ID NO: 59642 - DNA, 70 bp, Artificial Sequence
  Synthetic
gccaagcatttaggtgacactatagaggagaaatgctccaccagagtttcagagctatgctggaaacagc

SEQ ID NO: 59643 - DNA, 70 bp, Artificial Sequence
  Synthetic
gccaagcatttaggtgacactatagagtggatagaactaatcatcgtttcagagctatgctggaaacagc

SEQ ID NO: 59644 - DNA, 70 bp, Artificial Sequence
  Synthetic
gccaagcatttaggtgacactatagcctgcaatgattacatgaaggtttcagagctatgctggaaacagc

SEQ ID NO: 59645 - DNA, 70 bp, Artificial Sequence
  Synthetic
gccaagcatttaggtgacactatagctcaactgtgagcataccaagtttcagagctatgctggaaacagc

SEQ ID NO: 59646 - DNA, 70 bp, Artificial Sequence
  Synthetic
gccaagcatttaggtgacactatagcttgccgggtcgtcttgaaagtttcagagctatgctggaaacagc

SEQ ID NO: 59647 - DNA, 70 bp, Artificial Sequence
  Synthetic
gccaagcatttaggtgacactatagtgacaatcacatacatgaccgtttcagagctatgctggaaacagc

SEQ ID NO: 59648 - DNA, 70 bp, Artificial Sequence
  Synthetic
gccaagcatttaggtgacactatagttaatgctctagactcttccgtttcagagctatgctggaaacagc

SEQ ID NO: 59649 - DNA, 70 bp, Artificial Sequence
  Synthetic
gccaagcatttaggtgacactatagcctacatagtaaggtcttaggtttcagagctatgctggaaacagc

SEQ ID NO: 59650 - DNA, 70 bp, Artificial Sequence
  Synthetic
gccaagcatttaggtgacactataggcccagcctttaaaagttttgtttcagagctatgctggaaacagc

SEQ ID NO: 59651 - DNA, 70 bp, Artificial Sequence
  Synthetic
gccaagcatttaggtgacactatagatcggccgcttcacgtagctgtttcagagctatgctggaaacagc

SEQ ID NO: 59652 - DNA, 70 bp, Artificial Sequence
  Synthetic
gccaagcatttaggtgacactatagcacgttacagattcacgtgagtttcagagctatgctggaaacagc

SEQ ID NO: 59653 - DNA, 70 bp, Artificial Sequence
  Synthetic
gccaagcatttaggtgacactatagggatacagtttctgagggctgtttcagagctatgctggaaacagc

SEQ ID NO: 59654 - DNA, 70 bp, Artificial Sequence
  Synthetic
gccaagcatttaggtgacactatagtacgaaacagtgagatgaaggtttcagagctatgctggaaacagc

SEQ ID NO: 59655 - DNA, 70 bp, Artificial Sequence
  Synthetic
gccaagcatttaggtgacactatagcggcttatccacaggaccctgtttcagagctatgctggaaacagc

SEQ ID NO: 59656 - DNA, 70 bp, Artificial Sequence
  Synthetic
gccaagcatttaggtgacactataggaaattatggcgaaggcgaggtttcagagctatgctggaaacagc

SEQ ID NO: 59657 - DNA, 70 bp, Artificial Sequence
  Synthetic
gccaagcatttaggtgacactatagaagtgaaaggggctgtcaaggtttcagagctatgctggaaacagc

SEQ ID NO: 59658 - DNA, 70 bp, Artificial Sequence
  Synthetic
gccaagcatttaggtgacactataggggatctgcgcgagctctgagtttcagagctatgctggaaacagc

SEQ ID NO: 59659 - DNA, 70 bp, Artificial Sequence
  Synthetic
gccaagcatttaggtgacactatagagactgtggctgggccagccgtttcagagctatgctggaaacagc

SEQ ID NO: 59660 - DNA, 70 bp, Artificial Sequence
  Synthetic
gccaagcatttaggtgacactataggaggaacaaagatatcatgggtttcagagctatgctggaaacagc

SEQ ID NO: 59661 - DNA, 70 bp, Artificial Sequence
  Synthetic
gccaagcatttaggtgacactataggtgcctatggagatttgaaagtttcagagctatgctggaaacagc

SEQ ID NO: 59662 - DNA, 70 bp, Artificial Sequence
  Synthetic
gccaagcatttaggtgacactatagagaggataacagcaggttgagtttcagagctatgctggaaacagc

SEQ ID NO: 59663 - DNA, 70 bp, Artificial Sequence
  Synthetic
gccaagcatttaggtgacactatagaagcccaagaactccgagtggtttcagagctatgctggaaacagc

SEQ ID NO: 59664 - DNA, 70 bp, Artificial Sequence
  Synthetic
gccaagcatttaggtgacactatagacaaagtagcacatcctcaggtttcagagctatgctggaaacagc

SEQ ID NO: 59665 - DNA, 70 bp, Artificial Sequence
  Synthetic
gccaagcatttaggtgacactatagaatgggtcagtatttgctcagtttcagagctatgctggaaacagc

SEQ ID NO: 59666 - DNA, 70 bp, Artificial Sequence
  Synthetic
gccaagcatttaggtgacactataggtacaccctgaggaacaagggtttcagagctatgctggaaacagc

SEQ ID NO: 59667 - DNA, 70 bp, Artificial Sequence
  Synthetic
gccaagcatttaggtgacactataggacaaagtagcacattctcagtttcagagctatgctggaaacagc

SEQ ID NO: 59668 - DNA, 70 bp, Artificial Sequence
  Synthetic
gccaagcatttaggtgacactatagtgggtagagtttactgaagagtttcagagctatgctggaaacagc

SEQ ID NO: 59669 - DNA, 70 bp, Artificial Sequence
  Synthetic
gccaagcatttaggtgacactatagaccagctactcaggtgcctggtttcagagctatgctggaaacagc

SEQ ID NO: 59670 - DNA, 70 bp, Artificial Sequence
  Synthetic
gccaagcatttaggtgacactataggcccaatcattttcagtctagtttcagagctatgctggaaacagc

SEQ ID NO: 59671 - DNA, 70 bp, Artificial Sequence
  Synthetic
gccaagcatttaggtgacactatagcattttcagcctaaggaacagtttcagagctatgctggaaacagc

SEQ ID NO: 59672 - DNA, 70 bp, Artificial Sequence
  Synthetic
gccaagcatttaggtgacactataggcagttctgtggaaagagttgtttcagagctatgctggaaacagc

SEQ ID NO: 59673 - DNA, 70 bp, Artificial Sequence
  Synthetic
gccaagcatttaggtgacactatagctctgtgcagggctgttggtgtttcagagctatgctggaaacagc

SEQ ID NO: 59674 - DNA, 70 bp, Artificial Sequence
  Synthetic
gccaagcatttaggtgacactatagttaatgaagagaggttgtgagtttcagagctatgctggaaacagc

SEQ ID NO: 59675 - DNA, 70 bp, Artificial Sequence
  Synthetic
gccaagcatttaggtgacactataggggcagaaagcctctctcttgtttcagagctatgctggaaacagc

SEQ ID NO: 59676 - DNA, 70 bp, Artificial Sequence
  Synthetic
gccaagcatttaggtgacactataggatgccctatgcagagttgtgtttcagagctatgctggaaacagc

SEQ ID NO: 59677 - DNA, 70 bp, Artificial Sequence
  Synthetic
gccaagcatttaggtgacactatagtcagccctacgaagaacaatgtttcagagctatgctggaaacagc

SEQ ID NO: 59678 - DNA, 70 bp, Artificial Sequence
  Synthetic
gccaagcatttaggtgacactatagatactgatattagagcatccgtttcagagctatgctggaaacagc

SEQ ID NO: 59679 - DNA, 70 bp, Artificial Sequence
  Synthetic
gccaagcatttaggtgacactatagccctgcgacacttggtgaaggtttcagagctatgctggaaacagc

SEQ ID NO: 59680 - DNA, 70 bp, Artificial Sequence
  Synthetic
gccaagcatttaggtgacactatagagtgcccctaagccttcagtgtttcagagctatgctggaaacagc

SEQ ID NO: 59681 - DNA, 70 bp, Artificial Sequence
  Synthetic
gccaagcatttaggtgacactatagagaaaagtgttgggcaagaagtttcagagctatgctggaaacagc

SEQ ID NO: 59682 - DNA, 70 bp, Artificial Sequence
  Synthetic
gccaagcatttaggtgacactatagagcttccgagagtctacagcgtttcagagctatgctggaaacagc

SEQ ID NO: 59683 - DNA, 70 bp, Artificial Sequence
  Synthetic
gccaagcatttaggtgacactatagtagctcatcttggttgccacgtttcagagctatgctggaaacagc

SEQ ID NO: 59684 - DNA, 70 bp, Artificial Sequence
  Synthetic
gccaagcatttaggtgacactatagaggaactgaaagatgccctagtttcagagctatgctggaaacagc

SEQ ID NO: 59685 - DNA, 70 bp, Artificial Sequence
  Synthetic
gccaagcatttaggtgacactatagctgcctttcccagaacagctgtttcagagctatgctggaaacagc

SEQ ID NO: 59686 - DNA, 70 bp, Artificial Sequence
  Synthetic
gccaagcatttaggtgacactatagcatattcagcctgaggaatagtttcagagctatgctggaaacagc

SEQ ID NO: 59687 - DNA, 70 bp, Artificial Sequence
  Synthetic
gccaagcatttaggtgacactatagagagggagattgctgggtaagtttcagagctatgctggaaacagc

SEQ ID NO: 59688 - DNA, 70 bp, Artificial Sequence
  Synthetic
gccaagcatttaggtgacactatagaggaggtgcatcaggcacttgtttcagagctatgctggaaacagc

SEQ ID NO: 59689 - DNA, 70 bp, Artificial Sequence
  Synthetic
gccaagcatttaggtgacactatagaccctgtgatatatagtcttgtttcagagctatgctggaaacagc

SEQ ID NO: 59690 - DNA, 70 bp, Artificial Sequence
  Synthetic
gccaagcatttaggtgacactatagcagccctgaggaaagttctggtttcagagctatgctggaaacagc

SEQ ID NO: 59691 - DNA, 70 bp, Artificial Sequence
  Synthetic
gccaagcatttaggtgacactataggcagccctgaggaaagttctgtttcagagctatgctggaaacagc

SEQ ID NO: 59692 - DNA, 70 bp, Artificial Sequence
  Synthetic
gccaagcatttaggtgacactataggggagttccaacataatctagtttcagagctatgctggaaacagc

SEQ ID NO: 59693 - DNA, 70 bp, Artificial Sequence
  Synthetic
gccaagcatttaggtgacactataggacgaattctcattccaaacgtttcagagctatgctggaaacagc

SEQ ID NO: 59694 - DNA, 70 bp, Artificial Sequence
  Synthetic
gccaagcatttaggtgacactatagtttggctaactgttaaccccgtttcagagctatgctggaaacagc

SEQ ID NO: 59695 - DNA, 70 bp, Artificial Sequence
  Synthetic
gccaagcatttaggtgacactatagaaaaccctattcatgatctcgtttcagagctatgctggaaacagc

SEQ ID NO: 59696 - DNA, 70 bp, Artificial Sequence
  Synthetic
gccaagcatttaggtgacactatagaaggtcatgagaaggaaatggtttcagagctatgctggaaacagc

SEQ ID NO: 59697 - DNA, 70 bp, Artificial Sequence
  Synthetic
gccaagcatttaggtgacactataggagcaatgaaaaggtggcttgtttcagagctatgctggaaacagc

SEQ ID NO: 59698 - DNA, 70 bp, Artificial Sequence
  Synthetic
gccaagcatttaggtgacactatagccttgggtagagtgatcagagtttcagagctatgctggaaacagc

SEQ ID NO: 59699 - DNA, 70 bp, Artificial Sequence
  Synthetic
gccaagcatttaggtgacactatagatatccctcattagtcctaggtttcagagctatgctggaaacagc

SEQ ID NO: 59700 - DNA, 70 bp, Artificial Sequence
  Synthetic
gccaagcatttaggtgacactatagagaaagggaaaagcttcctggtttcagagctatgctggaaacagc

SEQ ID NO: 59701 - DNA, 70 bp, Artificial Sequence
  Synthetic
gccaagcatttaggtgacactatagtaaaacacctactgaacagagtttcagagctatgctggaaacagc

SEQ ID NO: 59702 - DNA, 70 bp, Artificial Sequence
  Synthetic
gccaagcatttaggtgacactatagatagagtataggattcagcagtttcagagctatgctggaaacagc

SEQ ID NO: 59703 - DNA, 70 bp, Artificial Sequence
  Synthetic
gccaagcatttaggtgacactatagagattatggggtttaacatggtttcagagctatgctggaaacagc

SEQ ID NO: 59704 - DNA, 70 bp, Artificial Sequence
  Synthetic
gccaagcatttaggtgacactatagtagaaacaaggatgtgaagggtttcagagctatgctggaaacagc

SEQ ID NO: 59705 - DNA, 70 bp, Artificial Sequence
  Synthetic
gccaagcatttaggtgacactatagtctgcgaaacaaggatgtaagtttcagagctatgctggaaacagc

SEQ ID NO: 59706 - DNA, 70 bp, Artificial Sequence
  Synthetic
gccaagcatttaggtgacactatagtaaaacacctaccgaacagagtttcagagctatgctggaaacagc

SEQ ID NO: 59707 - DNA, 70 bp, Artificial Sequence
  Synthetic
gccaagcatttaggtgacactatagataaatgcagatgtctgctcgtttcagagctatgctggaaacagc

SEQ ID NO: 59708 - DNA, 70 bp, Artificial Sequence
  Synthetic
gccaagcatttaggtgacactatagacggaacaaagaggtgaaaggtttcagagctatgctggaaacagc

SEQ ID NO: 59709 - DNA, 70 bp, Artificial Sequence
  Synthetic
gccaagcatttaggtgacactataggatgcaggcaggaattaggagtttcagagctatgctggaaacagc

SEQ ID NO: 59710 - DNA, 70 bp, Artificial Sequence
  Synthetic
gccaagcatttaggtgacactatagaagatgttaaacgggcaatagtttcagagctatgctggaaacagc

SEQ ID NO: 59711 - DNA, 70 bp, Artificial Sequence
  Synthetic
gccaagcatttaggtgacactatagggggcaggagtcgggcctccgtttcagagctatgctggaaacagc

SEQ ID NO: 59712 - DNA, 70 bp, Artificial Sequence
  Synthetic
gccaagcatttaggtgacactataggctctggggatgttgataaagtttcagagctatgctggaaacagc

SEQ ID NO: 59713 - DNA, 70 bp, Artificial Sequence
  Synthetic
gccaagcatttaggtgacactatagataatagggttaaagagggggtttcagagctatgctggaaacagc

SEQ ID NO: 59714 - DNA, 70 bp, Artificial Sequence
  Synthetic
gccaagcatttaggtgacactatagcttcacaaagagtctccacagtttcagagctatgctggaaacagc

SEQ ID NO: 59715 - DNA, 70 bp, Artificial Sequence
  Synthetic
gccaagcatttaggtgacactatagactgaggaagatgctgtcaagtttcagagctatgctggaaacagc

SEQ ID NO: 59716 - DNA, 70 bp, Artificial Sequence
  Synthetic
gccaagcatttaggtgacactatagtcttgttgaagagtttccgcgtttcagagctatgctggaaacagc

SEQ ID NO: 59717 - DNA, 70 bp, Artificial Sequence
  Synthetic
gccaagcatttaggtgacactatagtcttgctgaagagtttctgtgtttcagagctatgctggaaacagc

SEQ ID NO: 59718 - DNA, 70 bp, Artificial Sequence
  Synthetic
gccaagcatttaggtgacactatagcaggctgcttgaatgggtgagtttcagagctatgctggaaacagc

SEQ ID NO: 59719 - DNA, 70 bp, Artificial Sequence
  Synthetic
gccaagcatttaggtgacactatagaggaacagggatatgaagaggtttcagagctatgctggaaacagc

SEQ ID NO: 59720 - DNA, 70 bp, Artificial Sequence
  Synthetic
gccaagcatttaggtgacactatagaaggacatgcatggggctctgtttcagagctatgctggaaacagc

SEQ ID NO: 59721 - DNA, 70 bp, Artificial Sequence
  Synthetic
gccaagcatttaggtgacactatagtcctatggagaccctttcaggtttcagagctatgctggaaacagc

SEQ ID NO: 59722 - DNA, 70 bp, Artificial Sequence
  Synthetic
gccaagcatttaggtgacactatagtctgatgaatgactctgctcgtttcagagctatgctggaaacagc

SEQ ID NO: 59723 - DNA, 70 bp, Artificial Sequence
  Synthetic
gccaagcatttaggtgacactatagtggaaagggtcatttgtaaagtttcagagctatgctggaaacagc

SEQ ID NO: 59724 - DNA, 70 bp, Artificial Sequence
  Synthetic
gccaagcatttaggtgacactatagttgtgctgaagactctgcccgtttcagagctatgctggaaacagc

SEQ ID NO: 59725 - DNA, 70 bp, Artificial Sequence
  Synthetic
gccaagcatttaggtgacactataggaaaaaagtagttggcaggggtttcagagctatgctggaaacagc

SEQ ID NO: 59726 - DNA, 70 bp, Artificial Sequence
  Synthetic
gccaagcatttaggtgacactatagtgagaaagttaatctgggttgtttcagagctatgctggaaacagc

SEQ ID NO: 59727 - DNA, 70 bp, Artificial Sequence
  Synthetic
gccaagcatttaggtgacactatagtctagctgggaacagagacagtttcagagctatgctggaaacagc

SEQ ID NO: 59728 - DNA, 70 bp, Artificial Sequence
  Synthetic
gccaagcatttaggtgacactatagcttgagtaggtcaggcgcaggtttcagagctatgctggaaacagc

SEQ ID NO: 59729 - DNA, 70 bp, Artificial Sequence
  Synthetic
gccaagcatttaggtgacactatagctctactgaagagtttcccagtttcagagctatgctggaaacagc

SEQ ID NO: 59730 - DNA, 70 bp, Artificial Sequence
  Synthetic
gccaagcatttaggtgacactatagcctggagagactcttcaacagtttcagagctatgctggaaacagc

SEQ ID NO: 59731 - DNA, 70 bp, Artificial Sequence
  Synthetic
gccaagcatttaggtgacactataggagcccttctcattgggcgagtttcagagctatgctggaaacagc

SEQ ID NO: 59732 - DNA, 70 bp, Artificial Sequence
  Synthetic
gccaagcatttaggtgacactataggtttggcaaagttgatgcacgtttcagagctatgctggaaacagc

SEQ ID NO: 59733 - DNA, 70 bp, Artificial Sequence
  Synthetic
gccaagcatttaggtgacactatagagaaacaaagacatgaaacggtttcagagctatgctggaaacagc

SEQ ID NO: 59734 - DNA, 70 bp, Artificial Sequence
  Synthetic
gccaagcatttaggtgacactatagaccctttcatctacagcctggtttcagagctatgctggaaacagc

SEQ ID NO: 59735 - DNA, 70 bp, Artificial Sequence
  Synthetic
gccaagcatttaggtgacactataggaggggtttgaagaaattacgtttcagagctatgctggaaacagc

SEQ ID NO: 59736 - DNA, 70 bp, Artificial Sequence
  Synthetic
gccaagcatttaggtgacactatagtcttgctcataagcttcctcgtttcagagctatgctggaaacagc

SEQ ID NO: 59737 - DNA, 70 bp, Artificial Sequence
  Synthetic
gccaagcatttaggtgacactataggaaaggggctctcaggaagcgtttcagagctatgctggaaacagc

SEQ ID NO: 59738 - DNA, 70 bp, Artificial Sequence
  Synthetic
gccaagcatttaggtgacactatagtaaagaggctcttcagtcacgtttcagagctatgctggaaacagc

SEQ ID NO: 59739 - DNA, 70 bp, Artificial Sequence
  Synthetic
gccaagcatttaggtgacactatagttgggtaaactttttgtcaggtttcagagctatgctggaaacagc

SEQ ID NO: 59740 - DNA, 70 bp, Artificial Sequence
  Synthetic
gccaagcatttaggtgacactatagtcaagggaggcttcatgaaagtttcagagctatgctggaaacagc

SEQ ID NO: 59741 - DNA, 70 bp, Artificial Sequence
  Synthetic
gccaagcatttaggtgacactatagttctattgatgagctttctcgtttcagagctatgctggaaacagc

SEQ ID NO: 59742 - DNA, 70 bp, Artificial Sequence
  Synthetic
gccaagcatttaggtgacactatagacattgatctctgtttccaagtttcagagctatgctggaaacagc

SEQ ID NO: 59743 - DNA, 70 bp, Artificial Sequence
  Synthetic
gccaagcatttaggtgacactatagggagggcactgaggaaggaggtttcagagctatgctggaaacagc

SEQ ID NO: 59744 - DNA, 70 bp, Artificial Sequence
  Synthetic
gccaagcatttaggtgacactatagggtccatgagaacggtgtatgtttcagagctatgctggaaacagc

SEQ ID NO: 59745 - DNA, 70 bp, Artificial Sequence
  Synthetic
gccaagcatttaggtgacactatagaagtccaaggtactctaaaggtttcagagctatgctggaaacagc

SEQ ID NO: 59746 - DNA, 70 bp, Artificial Sequence
  Synthetic
gccaagcatttaggtgacactatagcctgaggagagcactgggcagtttcagagctatgctggaaacagc

SEQ ID NO: 59747 - DNA, 70 bp, Artificial Sequence
  Synthetic
gccaagcatttaggtgacactataggtgccctgaaaagagtgttggtttcagagctatgctggaaacagc

SEQ ID NO: 59748 - DNA, 70 bp, Artificial Sequence
  Synthetic
gccaagcatttaggtgacactataggagagtgctgggagtagaaagtttcagagctatgctggaaacagc

SEQ ID NO: 59749 - DNA, 70 bp, Artificial Sequence
  Synthetic
gccaagcatttaggtgacactataggcattcaacgactgcaattggtttcagagctatgctggaaacagc

SEQ ID NO: 59750 - DNA, 70 bp, Artificial Sequence
  Synthetic
gccaagcatttaggtgacactatagccagcacactccacgctctagtttcagagctatgctggaaacagc

SEQ ID NO: 59751 - DNA, 70 bp, Artificial Sequence
  Synthetic
gccaagcatttaggtgacactatagcctgggaaaatacatactgcgtttcagagctatgctggaaacagc

SEQ ID NO: 59752 - DNA, 70 bp, Artificial Sequence
  Synthetic
gccaagcatttaggtgacactatagtgaggagactgttgggatatgtttcagagctatgctggaaacagc

SEQ ID NO: 59753 - DNA, 70 bp, Artificial Sequence
  Synthetic
gccaagcatttaggtgacactatagaaaacaacccttcaaggatagtttcagagctatgctggaaacagc

SEQ ID NO: 59754 - DNA, 70 bp, Artificial Sequence
  Synthetic
gccaagcatttaggtgacactatagctcaagacccaggctgtgacgtttcagagctatgctggaaacagc

SEQ ID NO: 59755 - DNA, 70 bp, Artificial Sequence
  Synthetic
gccaagcatttaggtgacactataggccaggatctggaggctctggtttcagagctatgctggaaacagc

SEQ ID NO: 59756 - DNA, 70 bp, Artificial Sequence
  Synthetic
gccaagcatttaggtgacactatagaacttgcggagaagttagtagtttcagagctatgctggaaacagc

SEQ ID NO: 59757 - DNA, 70 bp, Artificial Sequence
  Synthetic
gccaagcatttaggtgacactatagtcttggcatcagcctcttgagtttcagagctatgctggaaacagc

SEQ ID NO: 59758 - DNA, 70 bp, Artificial Sequence
  Synthetic
gccaagcatttaggtgacactatagaaaggaaggctttaaaaggtgtttcagagctatgctggaaacagc

SEQ ID NO: 59759 - DNA, 70 bp, Artificial Sequence
  Synthetic
gccaagcatttaggtgacactatagctggggaaaggaagagaagtgtttcagagctatgctggaaacagc

SEQ ID NO: 59760 - DNA, 70 bp, Artificial Sequence
  Synthetic
gccaagcatttaggtgacactatagctgtggctctgcaggcaagcgtttcagagctatgctggaaacagc

SEQ ID NO: 59761 - DNA, 70 bp, Artificial Sequence
  Synthetic
gccaagcatttaggtgacactatagctctgaggaaagtagccacagtttcagagctatgctggaaacagc

SEQ ID NO: 59762 - DNA, 70 bp, Artificial Sequence
  Synthetic
gccaagcatttaggtgacactatagggagaaagtgcttctctcatgtttcagagctatgctggaaacagc

SEQ ID NO: 59763 - DNA, 70 bp, Artificial Sequence
  Synthetic
gccaagcatttaggtgacactatagctctgggttaacatcaaagcgtttcagagctatgctggaaacagc

SEQ ID NO: 59764 - DNA, 70 bp, Artificial Sequence
  Synthetic
gccaagcatttaggtgacactatagtctgggttaacatccaagctgtttcagagctatgctggaaacagc

SEQ ID NO: 59765 - DNA, 70 bp, Artificial Sequence
  Synthetic
gccaagcatttaggtgacactatagaaagttctagcaaaggctctgtttcagagctatgctggaaacagc

SEQ ID NO: 59766 - DNA, 70 bp, Artificial Sequence
  Synthetic
gccaagcatttaggtgacactataggctctgaggaaacttctctcgtttcagagctatgctggaaacagc

SEQ ID NO: 59767 - DNA, 70 bp, Artificial Sequence
  Synthetic
gccaagcatttaggtgacactatagtgctgctggacaaagccacagtttcagagctatgctggaaacagc

SEQ ID NO: 59768 - DNA, 70 bp, Artificial Sequence
  Synthetic
gccaagcatttaggtgacactatagaaagagactccagggaaagcgtttcagagctatgctggaaacagc

SEQ ID NO: 59769 - DNA, 70 bp, Artificial Sequence
  Synthetic
gccaagcatttaggtgacactatagtggggctcacacaaagctgagtttcagagctatgctggaaacagc

SEQ ID NO: 59770 - DNA, 70 bp, Artificial Sequence
  Synthetic
gccaagcatttaggtgacactatagtgggaatgggggatgtgacagtttcagagctatgctggaaacagc

SEQ ID NO: 59771 - DNA, 70 bp, Artificial Sequence
  Synthetic
gccaagcatttaggtgacactataggactattggggtgggagtgggtttcagagctatgctggaaacagc

SEQ ID NO: 59772 - DNA, 70 bp, Artificial Sequence
  Synthetic
gccaagcatttaggtgacactatagagtgaagagactaatggggtgtttcagagctatgctggaaacagc

SEQ ID NO: 59773 - DNA, 70 bp, Artificial Sequence
  Synthetic
gccaagcatttaggtgacactatagagatgctatgaagaaattgcgtttcagagctatgctggaaacagc

SEQ ID NO: 59774 - DNA, 70 bp, Artificial Sequence
  Synthetic
gccaagcatttaggtgacactatagatggccatgattattctttcgtttcagagctatgctggaaacagc

SEQ ID NO: 59775 - DNA, 70 bp, Artificial Sequence
  Synthetic
gccaagcatttaggtgacactatagttttctgaatcacttgtgtcgtttcagagctatgctggaaacagc

SEQ ID NO: 59776 - DNA, 70 bp, Artificial Sequence
  Synthetic
gccaagcatttaggtgacactatagtgagtcagagaatctgctctgtttcagagctatgctggaaacagc

SEQ ID NO: 59777 - DNA, 70 bp, Artificial Sequence
  Synthetic
gccaagcatttaggtgacactatagtattctgaatcactcgtgtcgtttcagagctatgctggaaacagc

SEQ ID NO: 59778 - DNA, 70 bp, Artificial Sequence
  Synthetic
gccaagcatttaggtgacactatagttctctgactcactcgtgtcgtttcagagctatgctggaaacagc

SEQ ID NO: 59779 - DNA, 70 bp, Artificial Sequence
  Synthetic
gccaagcatttaggtgacactatagagagcattcatgaagatcttgtttcagagctatgctggaaacagc

SEQ ID NO: 59780 - DNA, 70 bp, Artificial Sequence
  Synthetic
gccaagcatttaggtgacactatagatcttaggaaagggcaagtcgtttcagagctatgctggaaacagc

SEQ ID NO: 59781 - DNA, 70 bp, Artificial Sequence
  Synthetic
gccaagcatttaggtgacactatagagtgttcagggcactacagagtttcagagctatgctggaaacagc

SEQ ID NO: 59782 - DNA, 70 bp, Artificial Sequence
  Synthetic
gccaagcatttaggtgacactataggtgttaggaaagggcaagtggtttcagagctatgctggaaacagc

SEQ ID NO: 59783 - DNA, 70 bp, Artificial Sequence
  Synthetic
gccaagcatttaggtgacactatagcaaaaggcttcactcagtgagtttcagagctatgctggaaacagc

SEQ ID NO: 59784 - DNA, 70 bp, Artificial Sequence
  Synthetic
gccaagcatttaggtgacactatagggtcctcaaagggtgtcagggtttcagagctatgctggaaacagc

SEQ ID NO: 59785 - DNA, 70 bp, Artificial Sequence
  Synthetic
gccaagcatttaggtgacactatagcaggaataaggatgtcacaagtttcagagctatgctggaaacagc

SEQ ID NO: 59786 - DNA, 70 bp, Artificial Sequence
  Synthetic
gccaagcatttaggtgacactatagcgtcataggggcatttaaaagtttcagagctatgctggaaacagc

SEQ ID NO: 59787 - DNA, 70 bp, Artificial Sequence
  Synthetic
gccaagcatttaggtgacactatagaccagcaaaatgaggcccacgtttcagagctatgctggaaacagc

SEQ ID NO: 59788 - DNA, 70 bp, Artificial Sequence
  Synthetic
gccaagcatttaggtgacactataggtggcgactgtgatcaggaagtttcagagctatgctggaaacagc

SEQ ID NO: 59789 - DNA, 70 bp, Artificial Sequence
  Synthetic
gccaagcatttaggtgacactataggaggtgtgtgtcctcaggaagtttcagagctatgctggaaacagc

SEQ ID NO: 59790 - DNA, 70 bp, Artificial Sequence
  Synthetic
gccaagcatttaggtgacactatagtaggaataaggatgtcatgggtttcagagctatgctggaaacagc

SEQ ID NO: 59791 - DNA, 70 bp, Artificial Sequence
  Synthetic
gccaagcatttaggtgacactatagaagatgtcaccagggctctggtttcagagctatgctggaaacagc

SEQ ID NO: 59792 - DNA, 70 bp, Artificial Sequence
  Synthetic
gccaagcatttaggtgacactatagacctgcctttcaaaaagctagtttcagagctatgctggaaacagc

SEQ ID NO: 59793 - DNA, 70 bp, Artificial Sequence
  Synthetic
gccaagcatttaggtgacactataggggtgccttgaagagagttggtttcagagctatgctggaaacagc

SEQ ID NO: 59794 - DNA, 70 bp, Artificial Sequence
  Synthetic
gccaagcatttaggtgacactatagaaggtgtatgggtcggtgtggtttcagagctatgctggaaacagc

SEQ ID NO: 59795 - DNA, 70 bp, Artificial Sequence
  Synthetic
gccaagcatttaggtgacactataggggctggaccgctgcaggatgtttcagagctatgctggaaacagc

SEQ ID NO: 59796 - DNA, 70 bp, Artificial Sequence
  Synthetic
gccaagcatttaggtgacactatagttcttaaggtgtaaatgagcgtttcagagctatgctggaaacagc

SEQ ID NO: 59797 - DNA, 70 bp, Artificial Sequence
  Synthetic
gccaagcatttaggtgacactatagggggaagagagagctaggaagtttcagagctatgctggaaacagc

SEQ ID NO: 59798 - DNA, 70 bp, Artificial Sequence
  Synthetic
gccaagcatttaggtgacactatagggctggggagcctcaacgaggtttcagagctatgctggaaacagc

SEQ ID NO: 59799 - DNA, 70 bp, Artificial Sequence
  Synthetic
gccaagcatttaggtgacactatagtatggaggggcagggactcagtttcagagctatgctggaaacagc

SEQ ID NO: 59800 - DNA, 70 bp, Artificial Sequence
  Synthetic
gccaagcatttaggtgacactatagtgcttagcagagctggactcgtttcagagctatgctggaaacagc

SEQ ID NO: 59801 - DNA, 70 bp, Artificial Sequence
  Synthetic
gccaagcatttaggtgacactataggctcacagggaggcggtcacgtttcagagctatgctggaaacagc

SEQ ID NO: 59802 - DNA, 70 bp, Artificial Sequence
  Synthetic
gccaagcatttaggtgacactataggaggagatcactgacctgaggtttcagagctatgctggaaacagc

SEQ ID NO: 59803 - DNA, 70 bp, Artificial Sequence
  Synthetic
gccaagcatttaggtgacactatagctctgtgtcagctacttgtggtttcagagctatgctggaaacagc

SEQ ID NO: 59804 - DNA, 70 bp, Artificial Sequence
  Synthetic
gccaagcatttaggtgacactatagaagtaagcttagctgggaaagtttcagagctatgctggaaacagc

SEQ ID NO: 59805 - DNA, 70 bp, Artificial Sequence
  Synthetic
gccaagcatttaggtgacactataggttctaaggcaacaaatagggtttcagagctatgctggaaacagc

SEQ ID NO: 59806 - DNA, 70 bp, Artificial Sequence
  Synthetic
gccaagcatttaggtgacactatagcaagtgctatgaagaagctcgtttcagagctatgctggaaacagc

SEQ ID NO: 59807 - DNA, 70 bp, Artificial Sequence
  Synthetic
gccaagcatttaggtgacactatagcatacctccttacctacatggtttcagagctatgctggaaacagc

SEQ ID NO: 59808 - DNA, 70 bp, Artificial Sequence
  Synthetic
gccaagcatttaggtgacactatagcaaaaaggagaatccagggagtttcagagctatgctggaaacagc

SEQ ID NO: 59809 - DNA, 70 bp, Artificial Sequence
  Synthetic
gccaagcatttaggtgacactataggccatgagaaagttatggcagtttcagagctatgctggaaacagc

SEQ ID NO: 59810 - DNA, 70 bp, Artificial Sequence
  Synthetic
gccaagcatttaggtgacactatagaaagtgcaataaggaagcttgtttcagagctatgctggaaacagc

SEQ ID NO: 59811 - DNA, 70 bp, Artificial Sequence
  Synthetic
gccaagcatttaggtgacactatagtttcatttgagcattcctcagtttcagagctatgctggaaacagc

SEQ ID NO: 59812 - DNA, 70 bp, Artificial Sequence
  Synthetic
gccaagcatttaggtgacactatagaatatggaacagactgatgggtttcagagctatgctggaaacagc

SEQ ID NO: 59813 - DNA, 70 bp, Artificial Sequence
  Synthetic
gccaagcatttaggtgacactatagaaagtgccatgaggaagcttgtttcagagctatgctggaaacagc

SEQ ID NO: 59814 - DNA, 70 bp, Artificial Sequence
  Synthetic
gccaagcatttaggtgacactatagccatgagaaagctctttacagtttcagagctatgctggaaacagc

SEQ ID NO: 59815 - DNA, 70 bp, Artificial Sequence
  Synthetic
gccaagcatttaggtgacactatagcacagtcacagctttgtcaggtttcagagctatgctggaaacagc

SEQ ID NO: 59816 - DNA, 70 bp, Artificial Sequence
  Synthetic
gccaagcatttaggtgacactatagtgtagtagaaaggacatttcgtttcagagctatgctggaaacagc

SEQ ID NO: 59817 - DNA, 70 bp, Artificial Sequence
  Synthetic
gccaagcatttaggtgacactatagctctggagccaaataatctggtttcagagctatgctggaaacagc

SEQ ID NO: 59818 - DNA, 70 bp, Artificial Sequence
  Synthetic
gccaagcatttaggtgacactatagtgaaatgggaggctttggctgtttcagagctatgctggaaacagc

SEQ ID NO: 59819 - DNA, 70 bp, Artificial Sequence
  Synthetic
gccaagcatttaggtgacactatagcaagtgcctagtaatttgcagtttcagagctatgctggaaacagc

SEQ ID NO: 59820 - DNA, 70 bp, Artificial Sequence
  Synthetic
gccaagcatttaggtgacactatagtcttctcttcagtctcctcagtttcagagctatgctggaaacagc

SEQ ID NO: 59821 - DNA, 70 bp, Artificial Sequence
  Synthetic
gccaagcatttaggtgacactatagaagactcgtgccttctgaaagtttcagagctatgctggaaacagc

SEQ ID NO: 59822 - DNA, 70 bp, Artificial Sequence
  Synthetic
gccaagcatttaggtgacactatagaagattagggagacaccggcgtttcagagctatgctggaaacagc

SEQ ID NO: 59823 - DNA, 70 bp, Artificial Sequence
  Synthetic
gccaagcatttaggtgacactatagaatgtaagggtctgtgctccgtttcagagctatgctggaaacagc

SEQ ID NO: 59824 - DNA, 70 bp, Artificial Sequence
  Synthetic
gccaagcatttaggtgacactatagcttccgagagcagaaaatgggtttcagagctatgctggaaacagc

SEQ ID NO: 59825 - DNA, 70 bp, Artificial Sequence
  Synthetic
gccaagcatttaggtgacactataggacggctaggacaatcagaagtttcagagctatgctggaaacagc

SEQ ID NO: 59826 - DNA, 70 bp, Artificial Sequence
  Synthetic
gccaagcatttaggtgacactataggtgccttaaacaagttagtggtttcagagctatgctggaaacagc

SEQ ID NO: 59827 - DNA, 70 bp, Artificial Sequence
  Synthetic
gccaagcatttaggtgacactatagaaagtgccatgaagcagctcgtttcagagctatgctggaaacagc

SEQ ID NO: 59828 - DNA, 70 bp, Artificial Sequence
  Synthetic
gccaagcatttaggtgacactatagaagacatgaaagtggcaatggtttcagagctatgctggaaacagc

SEQ ID NO: 59829 - DNA, 70 bp, Artificial Sequence
  Synthetic
gccaagcatttaggtgacactataggaggaacaaagacatgaagagtttcagagctatgctggaaacagc

SEQ ID NO: 59830 - DNA, 70 bp, Artificial Sequence
  Synthetic
gccaagcatttaggtgacactatagtggccgtgtatacacaaacagtttcagagctatgctggaaacagc

SEQ ID NO: 59831 - DNA, 70 bp, Artificial Sequence
  Synthetic
gccaagcatttaggtgacactatagaacagctagtgatttacaaggtttcagagctatgctggaaacagc

SEQ ID NO: 59832 - DNA, 70 bp, Artificial Sequence
  Synthetic
gccaagcatttaggtgacactatagaataagacggctgagaaaatgtttcagagctatgctggaaacagc

SEQ ID NO: 59833 - DNA, 70 bp, Artificial Sequence
  Synthetic
gccaagcatttaggtgacactatagtagatgactggattcaaaacgtttcagagctatgctggaaacagc

SEQ ID NO: 59834 - DNA, 70 bp, Artificial Sequence
  Synthetic
gccaagcatttaggtgacactataggtgaactcctggaaaaactagtttcagagctatgctggaaacagc

SEQ ID NO: 59835 - DNA, 70 bp, Artificial Sequence
  Synthetic
gccaagcatttaggtgacactatagctggcccttcagcagatactgtttcagagctatgctggaaacagc

SEQ ID NO: 59836 - DNA, 70 bp, Artificial Sequence
  Synthetic
gccaagcatttaggtgacactataggaagaaactgcaaaaccgacgtttcagagctatgctggaaacagc

SEQ ID NO: 59837 - DNA, 70 bp, Artificial Sequence
  Synthetic
gccaagcatttaggtgacactatagatgactacagaaacctgactgtttcagagctatgctggaaacagc

SEQ ID NO: 59838 - DNA, 70 bp, Artificial Sequence
  Synthetic
gccaagcatttaggtgacactatagagctctccagagttttttcagtttcagagctatgctggaaacagc

SEQ ID NO: 59839 - DNA, 70 bp, Artificial Sequence
  Synthetic
gccaagcatttaggtgacactatagaagaagtaaagatagccatggtttcagagctatgctggaaacagc

SEQ ID NO: 59840 - DNA, 70 bp, Artificial Sequence
  Synthetic
gccaagcatttaggtgacactatagatggctgcttagtttcctcagtttcagagctatgctggaaacagc

SEQ ID NO: 59841 - DNA, 70 bp, Artificial Sequence
  Synthetic
gccaagcatttaggtgacactatagtgaaccattacctgaggccagtttcagagctatgctggaaacagc

SEQ ID NO: 59842 - DNA, 70 bp, Artificial Sequence
  Synthetic
gccaagcatttaggtgacactatagtctgtgcagaactaacatatgtttcagagctatgctggaaacagc

SEQ ID NO: 59843 - DNA, 70 bp, Artificial Sequence
  Synthetic
gccaagcatttaggtgacactatagaaaggcagccatgaggaagggtttcagagctatgctggaaacagc

SEQ ID NO: 59844 - DNA, 70 bp, Artificial Sequence
  Synthetic
gccaagcatttaggtgacactatagaaaggcagccatgaggaagtgtttcagagctatgctggaaacagc

SEQ ID NO: 59845 - DNA, 70 bp, Artificial Sequence
  Synthetic
gccaagcatttaggtgacactatagagtgaaagcttccatgaaaagtttcagagctatgctggaaacagc

SEQ ID NO: 59846 - DNA, 70 bp, Artificial Sequence
  Synthetic
gccaagcatttaggtgacactatagtcgacatgtagtctgtcaaggtttcagagctatgctggaaacagc

SEQ ID NO: 59847 - DNA, 70 bp, Artificial Sequence
  Synthetic
gccaagcatttaggtgacactatagttgacttaacaacttcctcagtttcagagctatgctggaaacagc

SEQ ID NO: 59848 - DNA, 70 bp, Artificial Sequence
  Synthetic
gccaagcatttaggtgacactatagagaacgccatgaggaaagtggtttcagagctatgctggaaacagc

SEQ ID NO: 59849 - DNA, 70 bp, Artificial Sequence
  Synthetic
gccaagcatttaggtgacactatagtgggcttacttggaaaaagcgtttcagagctatgctggaaacagc

SEQ ID NO: 59850 - DNA, 70 bp, Artificial Sequence
  Synthetic
gccaagcatttaggtgacactatagcaaggcaatggaatgccacagtttcagagctatgctggaaacagc

SEQ ID NO: 59851 - DNA, 70 bp, Artificial Sequence
  Synthetic
gccaagcatttaggtgacactatagtagggtcaagaggagcttaggtttcagagctatgctggaaacagc

SEQ ID NO: 59852 - DNA, 70 bp, Artificial Sequence
  Synthetic
gccaagcatttaggtgacactatagatgttttcttggaggctaaagtttcagagctatgctggaaacagc

SEQ ID NO: 59853 - DNA, 70 bp, Artificial Sequence
  Synthetic
gccaagcatttaggtgacactataggccatgaggagatttattgggtttcagagctatgctggaaacagc

SEQ ID NO: 59854 - DNA, 70 bp, Artificial Sequence
  Synthetic
gccaagcatttaggtgacactatagccatgaagaggctgtggattgtttcagagctatgctggaaacagc

SEQ ID NO: 59855 - DNA, 70 bp, Artificial Sequence
  Synthetic
gccaagcatttaggtgacactatagacaattggtttcatcagcgggtttcagagctatgctggaaacagc

SEQ ID NO: 59856 - DNA, 70 bp, Artificial Sequence
  Synthetic
gccaagcatttaggtgacactatagtaaacaattgggttcgtcaggtttcagagctatgctggaaacagc

SEQ ID NO: 59857 - DNA, 70 bp, Artificial Sequence
  Synthetic
gccaagcatttaggtgacactataggggaagttgcttaatgtatggtttcagagctatgctggaaacagc

SEQ ID NO: 59858 - DNA, 70 bp, Artificial Sequence
  Synthetic
gccaagcatttaggtgacactatagtccgccttttatctaaacatgtttcagagctatgctggaaacagc

SEQ ID NO: 59859 - DNA, 70 bp, Artificial Sequence
  Synthetic
gccaagcatttaggtgacactatagcctattttctgggcagagtagtttcagagctatgctggaaacagc

SEQ ID NO: 59860 - DNA, 70 bp, Artificial Sequence
  Synthetic
gccaagcatttaggtgacactataggagatcaggttccaattctagtttcagagctatgctggaaacagc

SEQ ID NO: 59861 - DNA, 70 bp, Artificial Sequence
  Synthetic
gccaagcatttaggtgacactatagaaaactaagcagattcagaggtttcagagctatgctggaaacagc

SEQ ID NO: 59862 - DNA, 70 bp, Artificial Sequence
  Synthetic
gccaagcatttaggtgacactatagctctgtatgttctcacaagggtttcagagctatgctggaaacagc

SEQ ID NO: 59863 - DNA, 70 bp, Artificial Sequence
  Synthetic
gccaagcatttaggtgacactatagcacacacgcttcagagccctgtttcagagctatgctggaaacagc

SEQ ID NO: 59864 - DNA, 70 bp, Artificial Sequence
  Synthetic
gccaagcatttaggtgacactatagaaggacttgcaggctgtggggtttcagagctatgctggaaacagc

SEQ ID NO: 59865 - DNA, 70 bp, Artificial Sequence
  Synthetic
gccaagcatttaggtgacactataggcagactgagcatagccttggtttcagagctatgctggaaacagc

SEQ ID NO: 59866 - DNA, 70 bp, Artificial Sequence
  Synthetic
gccaagcatttaggtgacactatagtaaataatagggttgagcacgtttcagagctatgctggaaacagc

SEQ ID NO: 59867 - DNA, 70 bp, Artificial Sequence
  Synthetic
gccaagcatttaggtgacactataggtcacttaggtgtttttggagtttcagagctatgctggaaacagc

SEQ ID NO: 59868 - DNA, 70 bp, Artificial Sequence
  Synthetic
gccaagcatttaggtgacactatagaggcatgcgtcactcgatccgtttcagagctatgctggaaacagc

SEQ ID NO: 59869 - DNA, 70 bp, Artificial Sequence
  Synthetic
gccaagcatttaggtgacactatagggtcttcacactgtagacaagtttcagagctatgctggaaacagc

SEQ ID NO: 59870 - DNA, 70 bp, Artificial Sequence
  Synthetic
gccaagcatttaggtgacactatagttccataaatcccaggcctggtttcagagctatgctggaaacagc

SEQ ID NO: 59871 - DNA, 70 bp, Artificial Sequence
  Synthetic
gccaagcatttaggtgacactatagttttgatgtggtgaaacatggtttcagagctatgctggaaacagc

SEQ ID NO: 59872 - DNA, 70 bp, Artificial Sequence
  Synthetic
gccaagcatttaggtgacactatagctctaatagcattcggacaagtttcagagctatgctggaaacagc

SEQ ID NO: 59873 - DNA, 70 bp, Artificial Sequence
  Synthetic
gccaagcatttaggtgacactatagacaagtttgtcctaaggagggtttcagagctatgctggaaacagc

SEQ ID NO: 59874 - DNA, 70 bp, Artificial Sequence
  Synthetic
gccaagcatttaggtgacactatagtagccccaggactcatttacgtttcagagctatgctggaaacagc

SEQ ID NO: 59875 - DNA, 70 bp, Artificial Sequence
  Synthetic
gccaagcatttaggtgacactatagaagaacaagcagatccaatggtttcagagctatgctggaaacagc

SEQ ID NO: 59876 - DNA, 70 bp, Artificial Sequence
  Synthetic
gccaagcatttaggtgacactatagttgcagcccaggaaggtggggtttcagagctatgctggaaacagc

SEQ ID NO: 59877 - DNA, 70 bp, Artificial Sequence
  Synthetic
gccaagcatttaggtgacactataggaggggtcttaggggaagatgtttcagagctatgctggaaacagc

SEQ ID NO: 59878 - DNA, 70 bp, Artificial Sequence
  Synthetic
gccaagcatttaggtgacactatagagaaaagagtctaagcattcgtttcagagctatgctggaaacagc

SEQ ID NO: 59879 - DNA, 70 bp, Artificial Sequence
  Synthetic
gccaagcatttaggtgacactatagcacacagattcgcattcatggtttcagagctatgctggaaacagc

SEQ ID NO: 59880 - DNA, 70 bp, Artificial Sequence
  Synthetic
gccaagcatttaggtgacactatagaatatggtcacgaatttgctgtttcagagctatgctggaaacagc

SEQ ID NO: 59881 - DNA, 70 bp, Artificial Sequence
  Synthetic
gccaagcatttaggtgacactatagtggtgctgtacctcccctctgtttcagagctatgctggaaacagc

SEQ ID NO: 59882 - DNA, 70 bp, Artificial Sequence
  Synthetic
gccaagcatttaggtgacactatagcaagcaaatccaggaacagggtttcagagctatgctggaaacagc

SEQ ID NO: 59883 - DNA, 70 bp, Artificial Sequence
  Synthetic
gccaagcatttaggtgacactataggactaagccaatactggaaggtttcagagctatgctggaaacagc

SEQ ID NO: 59884 - DNA, 70 bp, Artificial Sequence
  Synthetic
gccaagcatttaggtgacactatagttcatattgaagtcttccccgtttcagagctatgctggaaacagc

SEQ ID NO: 59885 - DNA, 70 bp, Artificial Sequence
  Synthetic
gccaagcatttaggtgacactatagcacttgtgctctaatctgttgtttcagagctatgctggaaacagc

SEQ ID NO: 59886 - DNA, 70 bp, Artificial Sequence
  Synthetic
gccaagcatttaggtgacactatagaagagtacctaatacatacggtttcagagctatgctggaaacagc

SEQ ID NO: 59887 - DNA, 70 bp, Artificial Sequence
  Synthetic
gccaagcatttaggtgacactatagaatttgctctcggatctgctgtttcagagctatgctggaaacagc

SEQ ID NO: 59888 - DNA, 70 bp, Artificial Sequence
  Synthetic
gccaagcatttaggtgacactatagatattagggagacagtgctggtttcagagctatgctggaaacagc

SEQ ID NO: 59889 - DNA, 70 bp, Artificial Sequence
  Synthetic
gccaagcatttaggtgacactatagagattcgagagagagtgctggtttcagagctatgctggaaacagc

SEQ ID NO: 59890 - DNA, 70 bp, Artificial Sequence
  Synthetic
gccaagcatttaggtgacactataggaccaagcagatcagagatagtttcagagctatgctggaaacagc

SEQ ID NO: 59891 - DNA, 70 bp, Artificial Sequence
  Synthetic
gccaagcatttaggtgacactatagctctttgaccactccaacctgtttcagagctatgctggaaacagc

SEQ ID NO: 59892 - DNA, 70 bp, Artificial Sequence
  Synthetic
gccaagcatttaggtgacactataggatattgtgttcatgaacccgtttcagagctatgctggaaacagc

SEQ ID NO: 59893 - DNA, 70 bp, Artificial Sequence
  Synthetic
gccaagcatttaggtgacactatagcactcgttctcgaatctgttgtttcagagctatgctggaaacagc

SEQ ID NO: 59894 - DNA, 70 bp, Artificial Sequence
  Synthetic
gccaagcatttaggtgacactatagccagagaaagaacatgtagagtttcagagctatgctggaaacagc

SEQ ID NO: 59895 - DNA, 70 bp, Artificial Sequence
  Synthetic
gccaagcatttaggtgacactatagcccaagaaaggatatgtagagtttcagagctatgctggaaacagc

SEQ ID NO: 59896 - DNA, 70 bp, Artificial Sequence
  Synthetic
gccaagcatttaggtgacactataggctcagagtgtttacacaaagtttcagagctatgctggaaacagc

SEQ ID NO: 59897 - DNA, 70 bp, Artificial Sequence
  Synthetic
gccaagcatttaggtgacactatagagagccttctccaaataccagtttcagagctatgctggaaacagc

SEQ ID NO: 59898 - DNA, 70 bp, Artificial Sequence
  Synthetic
gccaagcatttaggtgacactatagtaggttctttcttaagggaagtttcagagctatgctggaaacagc

SEQ ID NO: 59899 - DNA, 70 bp, Artificial Sequence
  Synthetic
gccaagcatttaggtgacactatagaagaccaagcagattcaggagtttcagagctatgctggaaacagc

SEQ ID NO: 59900 - DNA, 70 bp, Artificial Sequence
  Synthetic
gccaagcatttaggtgacactatagagtgttcattcacatgctgtgtttcagagctatgctggaaacagc

SEQ ID NO: 59901 - DNA, 70 bp, Artificial Sequence
  Synthetic
gccaagcatttaggtgacactatagttccagggtgataagggtgcgtttcagagctatgctggaaacagc

SEQ ID NO: 59902 - DNA, 70 bp, Artificial Sequence
  Synthetic
gccaagcatttaggtgacactatagagggttatccaaggatgttggtttcagagctatgctggaaacagc

SEQ ID NO: 59903 - DNA, 70 bp, Artificial Sequence
  Synthetic
gccaagcatttaggtgacactatagcgggctttttctgaatgtgagtttcagagctatgctggaaacagc

SEQ ID NO: 59904 - DNA, 70 bp, Artificial Sequence
  Synthetic
gccaagcatttaggtgacactatagtcttaacagcatacactgatgtttcagagctatgctggaaacagc

SEQ ID NO: 59905 - DNA, 70 bp, Artificial Sequence
  Synthetic
gccaagcatttaggtgacactatagagaagttactgcagagaggggtttcagagctatgctggaaacagc

SEQ ID NO: 59906 - DNA, 70 bp, Artificial Sequence
  Synthetic
gccaagcatttaggtgacactatagtgcagaggttgttgaagaaagtttcagagctatgctggaaacagc

SEQ ID NO: 59907 - DNA, 70 bp, Artificial Sequence
  Synthetic
gccaagcatttaggtgacactataggaatccaaaacctgctgaaggtttcagagctatgctggaaacagc

SEQ ID NO: 59908 - DNA, 70 bp, Artificial Sequence
  Synthetic
gccaagcatttaggtgacactataggaatccagaacctgctgagggtttcagagctatgctggaaacagc

SEQ ID NO: 59909 - DNA, 70 bp, Artificial Sequence
  Synthetic
gccaagcatttaggtgacactatagtaagggcaaacagcacctttgtttcagagctatgctggaaacagc

SEQ ID NO: 59910 - DNA, 70 bp, Artificial Sequence
  Synthetic
gccaagcatttaggtgacactatagttcctaaagctggagttactgtttcagagctatgctggaaacagc

SEQ ID NO: 59911 - DNA, 70 bp, Artificial Sequence
  Synthetic
gccaagcatttaggtgacactatagccctgtggaaggtgttggaagtttcagagctatgctggaaacagc

SEQ ID NO: 59912 - DNA, 70 bp, Artificial Sequence
  Synthetic
gccaagcatttaggtgacactataggaccccgggatttctcacgggtttcagagctatgctggaaacagc

SEQ ID NO: 59913 - DNA, 70 bp, Artificial Sequence
  Synthetic
gccaagcatttaggtgacactatagacagagaatacactttgtctgtttcagagctatgctggaaacagc

SEQ ID NO: 59914 - DNA, 70 bp, Artificial Sequence
  Synthetic
gccaagcatttaggtgacactatagttcccaggaaaatatgaaaggtttcagagctatgctggaaacagc

SEQ ID NO: 59915 - DNA, 70 bp, Artificial Sequence
  Synthetic
gccaagcatttaggtgacactatagtagatcagtgggtttaatgtgtttcagagctatgctggaaacagc

SEQ ID NO: 59916 - DNA, 70 bp, Artificial Sequence
  Synthetic
gccaagcatttaggtgacactatagtctcttttgcaacctctttagtttcagagctatgctggaaacagc

SEQ ID NO: 59917 - DNA, 70 bp, Artificial Sequence
  Synthetic
gccaagcatttaggtgacactatagaggccctaaagaagatcttagtttcagagctatgctggaaacagc

SEQ ID NO: 59918 - DNA, 70 bp, Artificial Sequence
  Synthetic
gccaagcatttaggtgacactataggatctacagtttgcggaacagtttcagagctatgctggaaacagc

SEQ ID NO: 59919 - DNA, 70 bp, Artificial Sequence
  Synthetic
gccaagcatttaggtgacactatagcctagacactgataaggtgggtttcagagctatgctggaaacagc

SEQ ID NO: 59920 - DNA, 70 bp, Artificial Sequence
  Synthetic
gccaagcatttaggtgacactatagggtttggggtaggaaaacaagtttcagagctatgctggaaacagc

SEQ ID NO: 59921 - DNA, 70 bp, Artificial Sequence
  Synthetic
gccaagcatttaggtgacactataggggaaggcaaaggcctctatgtttcagagctatgctggaaacagc

SEQ ID NO: 59922 - DNA, 70 bp, Artificial Sequence
  Synthetic
gccaagcatttaggtgacactatagattcatgaaggttgttgagagtttcagagctatgctggaaacagc

SEQ ID NO: 59923 - DNA, 70 bp, Artificial Sequence
  Synthetic
gccaagcatttaggtgacactatagacactttcttgaatgcattcgtttcagagctatgctggaaacagc

SEQ ID NO: 59924 - DNA, 70 bp, Artificial Sequence
  Synthetic
gccaagcatttaggtgacactatagaagaagtgaaaagtgctctcgtttcagagctatgctggaaacagc

SEQ ID NO: 59925 - DNA, 70 bp, Artificial Sequence
  Synthetic
gccaagcatttaggtgacactatagaggcaaaattgtctgtaggagtttcagagctatgctggaaacagc

SEQ ID NO: 59926 - DNA, 70 bp, Artificial Sequence
  Synthetic
gccaagcatttaggtgacactataggattccactgtccagggcaggtttcagagctatgctggaaacagc

SEQ ID NO: 59927 - DNA, 70 bp, Artificial Sequence
  Synthetic
gccaagcatttaggtgacactatagacccattgatctacagccttgtttcagagctatgctggaaacagc

SEQ ID NO: 59928 - DNA, 70 bp, Artificial Sequence
  Synthetic
gccaagcatttaggtgacactatagaagacgtgaaggatgctttcgtttcagagctatgctggaaacagc

SEQ ID NO: 59929 - DNA, 70 bp, Artificial Sequence
  Synthetic
gccaagcatttaggtgacactatagtatttctcagactgtagatcgtttcagagctatgctggaaacagc

SEQ ID NO: 59930 - DNA, 70 bp, Artificial Sequence
  Synthetic
gccaagcatttaggtgacactatagggatacagtcaccgagatacgtttcagagctatgctggaaacagc

SEQ ID NO: 59931 - DNA, 70 bp, Artificial Sequence
  Synthetic
gccaagcatttaggtgacactatagcaggagtaaggaagtaaagagtttcagagctatgctggaaacagc

SEQ ID NO: 59932 - DNA, 70 bp, Artificial Sequence
  Synthetic
gccaagcatttaggtgacactatagtttctcagactgtagatgatgtttcagagctatgctggaaacagc

SEQ ID NO: 59933 - DNA, 70 bp, Artificial Sequence
  Synthetic
gccaagcatttaggtgacactatagagacagagtctatcatatctgtttcagagctatgctggaaacagc

SEQ ID NO: 59934 - DNA, 70 bp, Artificial Sequence
  Synthetic
gccaagcatttaggtgacactataggtttctcaggctgtagatcagtttcagagctatgctggaaacagc

SEQ ID NO: 59935 - DNA, 70 bp, Artificial Sequence
  Synthetic
gccaagcatttaggtgacactatagtaaatcaacggattcagcacgtttcagagctatgctggaaacagc

SEQ ID NO: 59936 - DNA, 70 bp, Artificial Sequence
  Synthetic
gccaagcatttaggtgacactatagcgtaaaggaggcagtgaaaagtttcagagctatgctggaaacagc

SEQ ID NO: 59937 - DNA, 70 bp, Artificial Sequence
  Synthetic
gccaagcatttaggtgacactatagaccaaatttgcttgaagaaggtttcagagctatgctggaaacagc

SEQ ID NO: 59938 - DNA, 70 bp, Artificial Sequence
  Synthetic
gccaagcatttaggtgacactatagccaaatttgcttgaagaagggtttcagagctatgctggaaacagc

SEQ ID NO: 59939 - DNA, 70 bp, Artificial Sequence
  Synthetic
gccaagcatttaggtgacactataggaaacaaatgtcatcccctcgtttcagagctatgctggaaacagc

SEQ ID NO: 59940 - DNA, 70 bp, Artificial Sequence
  Synthetic
gccaagcatttaggtgacactatagaggagataaagatacaccaggtttcagagctatgctggaaacagc

SEQ ID NO: 59941 - DNA, 70 bp, Artificial Sequence
  Synthetic
gccaagcatttaggtgacactatagggctccaaaattcactcctagtttcagagctatgctggaaacagc

SEQ ID NO: 59942 - DNA, 70 bp, Artificial Sequence
  Synthetic
gccaagcatttaggtgacactatagaaagctctcagaaaagtgatgtttcagagctatgctggaaacagc

SEQ ID NO: 59943 - DNA, 70 bp, Artificial Sequence
  Synthetic
gccaagcatttaggtgacactataggccatgcaacaaatgattaggtttcagagctatgctggaaacagc

SEQ ID NO: 59944 - DNA, 70 bp, Artificial Sequence
  Synthetic
gccaagcatttaggtgacactatagtcccctaatcatttgttgtagtttcagagctatgctggaaacagc

SEQ ID NO: 59945 - DNA, 70 bp, Artificial Sequence
  Synthetic
gccaagcatttaggtgacactataggaggaataaagatgtgaagcgtttcagagctatgctggaaacagc

SEQ ID NO: 59946 - DNA, 70 bp, Artificial Sequence
  Synthetic
gccaagcatttaggtgacactatagtctgctgatcactttcatcagtttcagagctatgctggaaacagc

SEQ ID NO: 59947 - DNA, 70 bp, Artificial Sequence
  Synthetic
gccaagcatttaggtgacactataggttcagcatagggattactggtttcagagctatgctggaaacagc

SEQ ID NO: 59948 - DNA, 70 bp, Artificial Sequence
  Synthetic
gccaagcatttaggtgacactatagcaatcaccaagacatatgtggtttcagagctatgctggaaacagc

SEQ ID NO: 59949 - DNA, 70 bp, Artificial Sequence
  Synthetic
gccaagcatttaggtgacactatagcaggaacaaggagattaagggtttcagagctatgctggaaacagc

SEQ ID NO: 59950 - DNA, 70 bp, Artificial Sequence
  Synthetic
gccaagcatttaggtgacactatagtcaaagaaagccttggataagtttcagagctatgctggaaacagc

SEQ ID NO: 59951 - DNA, 70 bp, Artificial Sequence
  Synthetic
gccaagcatttaggtgacactataggcggaacaaagatgtaaagggtttcagagctatgctggaaacagc

SEQ ID NO: 59952 - DNA, 70 bp, Artificial Sequence
  Synthetic
gccaagcatttaggtgacactatagatcccgtcatctacagtttggtttcagagctatgctggaaacagc

SEQ ID NO: 59953 - DNA, 70 bp, Artificial Sequence
  Synthetic
gccaagcatttaggtgacactatagatcccatcatctatagtttggtttcagagctatgctggaaacagc

SEQ ID NO: 59954 - DNA, 70 bp, Artificial Sequence
  Synthetic
gccaagcatttaggtgacactatagagtgagtttactatccaaaggtttcagagctatgctggaaacagc

SEQ ID NO: 59955 - DNA, 70 bp, Artificial Sequence
  Synthetic
gccaagcatttaggtgacactataggaggaacaaggatgtgaaaggtttcagagctatgctggaaacagc

SEQ ID NO: 59956 - DNA, 70 bp, Artificial Sequence
  Synthetic
gccaagcatttaggtgacactatagagctagcagaaatgtatagagtttcagagctatgctggaaacagc

SEQ ID NO: 59957 - DNA, 70 bp, Artificial Sequence
  Synthetic
gccaagcatttaggtgacactataggaagaaactggcatattgccgtttcagagctatgctggaaacagc

SEQ ID NO: 59958 - DNA, 70 bp, Artificial Sequence
  Synthetic
gccaagcatttaggtgacactatagttgaaaaaggccttgggcttgtttcagagctatgctggaaacagc

SEQ ID NO: 59959 - DNA, 70 bp, Artificial Sequence
  Synthetic
gccaagcatttaggtgacactatagagagaggctggctgtgtattgtttcagagctatgctggaaacagc

SEQ ID NO: 59960 - DNA, 70 bp, Artificial Sequence
  Synthetic
gccaagcatttaggtgacactatagaagctttcattaacatggcagtttcagagctatgctggaaacagc

SEQ ID NO: 59961 - DNA, 70 bp, Artificial Sequence
  Synthetic
gccaagcatttaggtgacactatagtttcacttgcttgttcctcagtttcagagctatgctggaaacagc

SEQ ID NO: 59962 - DNA, 70 bp, Artificial Sequence
  Synthetic
gccaagcatttaggtgacactatagtttgtggaccacatttttgagtttcagagctatgctggaaacagc

SEQ ID NO: 59963 - DNA, 70 bp, Artificial Sequence
  Synthetic
gccaagcatttaggtgacactataggcaagtgaaacaagctttcagtttcagagctatgctggaaacagc

SEQ ID NO: 59964 - DNA, 70 bp, Artificial Sequence
  Synthetic
gccaagcatttaggtgacactataggcaggtgaaagaagtcttctgtttcagagctatgctggaaacagc

SEQ ID NO: 59965 - DNA, 70 bp, Artificial Sequence
  Synthetic
gccaagcatttaggtgacactataggcaggtgaaacaggcccttagtttcagagctatgctggaaacagc

SEQ ID NO: 59966 - DNA, 70 bp, Artificial Sequence
  Synthetic
gccaagcatttaggtgacactatagcaagccatctgcaaaagaaggtttcagagctatgctggaaacagc

SEQ ID NO: 59967 - DNA, 70 bp, Artificial Sequence
  Synthetic
gccaagcatttaggtgacactataggcaactctttcattcgctgagtttcagagctatgctggaaacagc

SEQ ID NO: 59968 - DNA, 70 bp, Artificial Sequence
  Synthetic
gccaagcatttaggtgacactatagaataaagggattcaacatgggtttcagagctatgctggaaacagc

SEQ ID NO: 59969 - DNA, 70 bp, Artificial Sequence
  Synthetic
gccaagcatttaggtgacactataggaagcaagccttcaagagcagtttcagagctatgctggaaacagc

SEQ ID NO: 59970 - DNA, 70 bp, Artificial Sequence
  Synthetic
gccaagcatttaggtgacactataggcaggtgaaacaagcatttagtttcagagctatgctggaaacagc

SEQ ID NO: 59971 - DNA, 70 bp, Artificial Sequence
  Synthetic
gccaagcatttaggtgacactatagactctgctgaagaaatggaagtttcagagctatgctggaaacagc

SEQ ID NO: 59972 - DNA, 70 bp, Artificial Sequence
  Synthetic
gccaagcatttaggtgacactatagagctcctctctttctaacacgtttcagagctatgctggaaacagc

SEQ ID NO: 59973 - DNA, 70 bp, Artificial Sequence
  Synthetic
gccaagcatttaggtgacactatagaatatcttacttgaggtcccgtttcagagctatgctggaaacagc

SEQ ID NO: 59974 - DNA, 70 bp, Artificial Sequence
  Synthetic
gccaagcatttaggtgacactatagaaagtgttgaacaagcctgggtttcagagctatgctggaaacagc

SEQ ID NO: 59975 - DNA, 70 bp, Artificial Sequence
  Synthetic
gccaagcatttaggtgacactatagagaagagggctggttgggctgtttcagagctatgctggaaacagc

SEQ ID NO: 59976 - DNA, 70 bp, Artificial Sequence
  Synthetic
gccaagcatttaggtgacactatagcttgaggaatgagaaggtacgtttcagagctatgctggaaacagc

SEQ ID NO: 59977 - DNA, 70 bp, Artificial Sequence
  Synthetic
gccaagcatttaggtgacactatagggaggcagctaaagagaattgtttcagagctatgctggaaacagc

SEQ ID NO: 59978 - DNA, 70 bp, Artificial Sequence
  Synthetic
gccaagcatttaggtgacactataggactagctttatctcccttcgtttcagagctatgctggaaacagc

SEQ ID NO: 59979 - DNA, 70 bp, Artificial Sequence
  Synthetic
gccaagcatttaggtgacactatagtcactatcctagggatgttcgtttcagagctatgctggaaacagc

SEQ ID NO: 59980 - DNA, 70 bp, Artificial Sequence
  Synthetic
gccaagcatttaggtgacactatagaaggaagtgaagggagctctgtttcagagctatgctggaaacagc

SEQ ID NO: 59981 - DNA, 70 bp, Artificial Sequence
  Synthetic
gccaagcatttaggtgacactatagaggtagtggcaggcgttttagtttcagagctatgctggaaacagc

SEQ ID NO: 59982 - DNA, 70 bp, Artificial Sequence
  Synthetic
gccaagcatttaggtgacactatagaactgagggtcacaagtcaagtttcagagctatgctggaaacagc

SEQ ID NO: 59983 - DNA, 70 bp, Artificial Sequence
  Synthetic
gccaagcatttaggtgacactataggaggctgaaaggcctttgcagtttcagagctatgctggaaacagc

SEQ ID NO: 59984 - DNA, 70 bp, Artificial Sequence
  Synthetic
gccaagcatttaggtgacactatagtactttgcatgaccagtcttgtttcagagctatgctggaaacagc

SEQ ID NO: 59985 - DNA, 70 bp, Artificial Sequence
  Synthetic
gccaagcatttaggtgacactatagaagtgggccccagggaaatggtttcagagctatgctggaaacagc

SEQ ID NO: 59986 - DNA, 70 bp, Artificial Sequence
  Synthetic
gccaagcatttaggtgacactatagaccccttcatctacagtctggtttcagagctatgctggaaacagc

SEQ ID NO: 59987 - DNA, 70 bp, Artificial Sequence
  Synthetic
gccaagcatttaggtgacactataggctctgaaaatgtccttcaggtttcagagctatgctggaaacagc

SEQ ID NO: 59988 - DNA, 70 bp, Artificial Sequence
  Synthetic
gccaagcatttaggtgacactataggcttagagccctgcaatcatgtttcagagctatgctggaaacagc

SEQ ID NO: 59989 - DNA, 70 bp, Artificial Sequence
  Synthetic
gccaagcatttaggtgacactatagtttaatggtgacatcactgcgtttcagagctatgctggaaacagc

SEQ ID NO: 59990 - DNA, 70 bp, Artificial Sequence
  Synthetic
gccaagcatttaggtgacactataggggcaacgtctctcaaagaggtttcagagctatgctggaaacagc

SEQ ID NO: 59991 - DNA, 70 bp, Artificial Sequence
  Synthetic
gccaagcatttaggtgacactataggggcagcctcttgtttgtgagtttcagagctatgctggaaacagc

SEQ ID NO: 59992 - DNA, 70 bp, Artificial Sequence
  Synthetic
gccaagcatttaggtgacactataggatttgtcatggacaagagtgtttcagagctatgctggaaacagc

SEQ ID NO: 59993 - DNA, 70 bp, Artificial Sequence
  Synthetic
gccaagcatttaggtgacactatagagtgccctgtgcaggctgcagtttcagagctatgctggaaacagc

SEQ ID NO: 59994 - DNA, 70 bp, Artificial Sequence
  Synthetic
gccaagcatttaggtgacactatagaggagatgaagaaagctttggtttcagagctatgctggaaacagc

SEQ ID NO: 59995 - DNA, 70 bp, Artificial Sequence
  Synthetic
gccaagcatttaggtgacactataggtgccatttgctttggattcgtttcagagctatgctggaaacagc

SEQ ID NO: 59996 - DNA, 70 bp, Artificial Sequence
  Synthetic
gccaagcatttaggtgacactatagaggacatgttgaaggctttggtttcagagctatgctggaaacagc

SEQ ID NO: 59997 - DNA, 70 bp, Artificial Sequence
  Synthetic
gccaagcatttaggtgacactataggccgtgcagaaaacgctgaggtttcagagctatgctggaaacagc

SEQ ID NO: 59998 - DNA, 70 bp, Artificial Sequence
  Synthetic
gccaagcatttaggtgacactataggttgccctgaggagaactttgtttcagagctatgctggaaacagc

SEQ ID NO: 59999 - DNA, 70 bp, Artificial Sequence
  Synthetic
gccaagcatttaggtgacactatagaggatgtcaaagttgcactggtttcagagctatgctggaaacagc

SEQ ID NO: 60000 - DNA, 70 bp, Artificial Sequence
  Synthetic
gccaagcatttaggtgacactatagctctcttcagggttttgcccgtttcagagctatgctggaaacagc

SEQ ID NO: 60001 - DNA, 70 bp, Artificial Sequence
  Synthetic
gccaagcatttaggtgacactatagctttgacgtccttattcctcgtttcagagctatgctggaaacagc

SEQ ID NO: 60002 - DNA, 70 bp, Artificial Sequence
  Synthetic
gccaagcatttaggtgacactataggcattaaggaaggtcttagtgtttcagagctatgctggaaacagc

SEQ ID NO: 60003 - DNA, 70 bp, Artificial Sequence
  Synthetic
gccaagcatttaggtgacactatagtgaagaagatgactaggggagtttcagagctatgctggaaacagc

SEQ ID NO: 60004 - DNA, 70 bp, Artificial Sequence
  Synthetic
gccaagcatttaggtgacactatagatcccttgatatatagtctggtttcagagctatgctggaaacagc

SEQ ID NO: 60005 - DNA, 70 bp, Artificial Sequence
  Synthetic
gccaagcatttaggtgacactatagttctctgtagcattttcttcgtttcagagctatgctggaaacagc

SEQ ID NO: 60006 - DNA, 70 bp, Artificial Sequence
  Synthetic
gccaagcatttaggtgacactatagtttcttaggctatagattgggtttcagagctatgctggaaacagc

SEQ ID NO: 60007 - DNA, 70 bp, Artificial Sequence
  Synthetic
gccaagcatttaggtgacactatagttgccctgaagaaaacgctagtttcagagctatgctggaaacagc

SEQ ID NO: 60008 - DNA, 70 bp, Artificial Sequence
  Synthetic
gccaagcatttaggtgacactatagtgcagagaagacaggactccgtttcagagctatgctggaaacagc

SEQ ID NO: 60009 - DNA, 70 bp, Artificial Sequence
  Synthetic
gccaagcatttaggtgacactatagatccactcatctacagtctggtttcagagctatgctggaaacagc

SEQ ID NO: 60010 - DNA, 70 bp, Artificial Sequence
  Synthetic
gccaagcatttaggtgacactataggatctacagcctgaggaatagtttcagagctatgctggaaacagc

SEQ ID NO: 60011 - DNA, 70 bp, Artificial Sequence
  Synthetic
gccaagcatttaggtgacactatagatcccttgatctacagcctggtttcagagctatgctggaaacagc

SEQ ID NO: 60012 - DNA, 70 bp, Artificial Sequence
  Synthetic
gccaagcatttaggtgacactatagatccgttgatctacagcctagtttcagagctatgctggaaacagc

SEQ ID NO: 60013 - DNA, 70 bp, Artificial Sequence
  Synthetic
gccaagcatttaggtgacactatagaatatgccctacgaaggacagtttcagagctatgctggaaacagc

SEQ ID NO: 60014 - DNA, 70 bp, Artificial Sequence
  Synthetic
gccaagcatttaggtgacactatagttacagcttaagaaacgaaggtttcagagctatgctggaaacagc

SEQ ID NO: 60015 - DNA, 70 bp, Artificial Sequence
  Synthetic
gccaagcatttaggtgacactatagcgcgctgcgcgcggcgcccagtttcagagctatgctggaaacagc

SEQ ID NO: 60016 - DNA, 70 bp, Artificial Sequence
  Synthetic
gccaagcatttaggtgacactatagctggcagtcaccatattctagtttcagagctatgctggaaacagc

SEQ ID NO: 60017 - DNA, 70 bp, Artificial Sequence
  Synthetic
gccaagcatttaggtgacactatagctatagcctccagaataagggtttcagagctatgctggaaacagc

SEQ ID NO: 60018 - DNA, 70 bp, Artificial Sequence
  Synthetic
gccaagcatttaggtgacactatagagcagcgtttcatcccatctgtttcagagctatgctggaaacagc

SEQ ID NO: 60019 - DNA, 70 bp, Artificial Sequence
  Synthetic
gccaagcatttaggtgacactatagaacgctgctgtcaactattcgtttcagagctatgctggaaacagc

SEQ ID NO: 60020 - DNA, 70 bp, Artificial Sequence
  Synthetic
gccaagcatttaggtgacactatagagtctgtgttgctttcctgagtttcagagctatgctggaaacagc

SEQ ID NO: 60021 - DNA, 70 bp, Artificial Sequence
  Synthetic
gccaagcatttaggtgacactatagaaggaataaggatgtgaaaggtttcagagctatgctggaaacagc

SEQ ID NO: 60022 - DNA, 70 bp, Artificial Sequence
  Synthetic
gccaagcatttaggtgacactatagaaaggtcgctaggagactccgtttcagagctatgctggaaacagc

SEQ ID NO: 60023 - DNA, 70 bp, Artificial Sequence
  Synthetic
gccaagcatttaggtgacactataggaggaacaaagatgtccaaggtttcagagctatgctggaaacagc

SEQ ID NO: 60024 - DNA, 70 bp, Artificial Sequence
  Synthetic
gccaagcatttaggtgacactatagtggagatggttaggacaactgtttcagagctatgctggaaacagc

SEQ ID NO: 60025 - DNA, 70 bp, Artificial Sequence
  Synthetic
gccaagcatttaggtgacactataggcctgctagaagaccctaaagtttcagagctatgctggaaacagc

SEQ ID NO: 60026 - DNA, 70 bp, Artificial Sequence
  Synthetic
gccaagcatttaggtgacactataggcccggcagccactatgcctgtttcagagctatgctggaaacagc

SEQ ID NO: 60027 - DNA, 70 bp, Artificial Sequence
  Synthetic
gccaagcatttaggtgacactatagcagcctgcaggtcttgtgaggtttcagagctatgctggaaacagc

SEQ ID NO: 60028 - DNA, 70 bp, Artificial Sequence
  Synthetic
gccaagcatttaggtgacactatagtatcagatgcccccttgagggtttcagagctatgctggaaacagc

SEQ ID NO: 60029 - DNA, 70 bp, Artificial Sequence
  Synthetic
gccaagcatttaggtgacactatagtcgcctgcagggggagctgcgtttcagagctatgctggaaacagc

SEQ ID NO: 60030 - DNA, 70 bp, Artificial Sequence
  Synthetic
gccaagcatttaggtgacactatagtccggactttcattttgagggtttcagagctatgctggaaacagc

SEQ ID NO: 60031 - DNA, 70 bp, Artificial Sequence
  Synthetic
gccaagcatttaggtgacactataggcgctgaaagacgagtaaaggtttcagagctatgctggaaacagc

SEQ ID NO: 60032 - DNA, 70 bp, Artificial Sequence
  Synthetic
gccaagcatttaggtgacactatagcttggaaaaggaagaagagggtttcagagctatgctggaaacagc

SEQ ID NO: 60033 - DNA, 70 bp, Artificial Sequence
  Synthetic
gccaagcatttaggtgacactataggtggcaagactaacatgggggtttcagagctatgctggaaacagc

SEQ ID NO: 60034 - DNA, 70 bp, Artificial Sequence
  Synthetic
gccaagcatttaggtgacactataggggcaacatcctcactaagcgtttcagagctatgctggaaacagc

SEQ ID NO: 60035 - DNA, 70 bp, Artificial Sequence
  Synthetic
gccaagcatttaggtgacactatagacttcatcagagctattgcagtttcagagctatgctggaaacagc

SEQ ID NO: 60036 - DNA, 70 bp, Artificial Sequence
  Synthetic
gccaagcatttaggtgacactatagatactaaagagcattcagtcgtttcagagctatgctggaaacagc

SEQ ID NO: 60037 - DNA, 70 bp, Artificial Sequence
  Synthetic
gccaagcatttaggtgacactatagaaatgctgccagtgctcaaagtttcagagctatgctggaaacagc

SEQ ID NO: 60038 - DNA, 70 bp, Artificial Sequence
  Synthetic
gccaagcatttaggtgacactatagggaggagggggaatcctagcgtttcagagctatgctggaaacagc

SEQ ID NO: 60039 - DNA, 70 bp, Artificial Sequence
  Synthetic
gccaagcatttaggtgacactatagctacatggtgttcggatcttgtttcagagctatgctggaaacagc

SEQ ID NO: 60040 - DNA, 70 bp, Artificial Sequence
  Synthetic
gccaagcatttaggtgacactatagttggcatcaacaaatactgagtttcagagctatgctggaaacagc

SEQ ID NO: 60041 - DNA, 70 bp, Artificial Sequence
  Synthetic
gccaagcatttaggtgacactatagctccacggagtccggattttgtttcagagctatgctggaaacagc

SEQ ID NO: 60042 - DNA, 70 bp, Artificial Sequence
  Synthetic
gccaagcatttaggtgacactatagctcagaagtcaaattcgtccgtttcagagctatgctggaaacagc

SEQ ID NO: 60043 - DNA, 70 bp, Artificial Sequence
  Synthetic
gccaagcatttaggtgacactatagtgcccggacattttctgaaagtttcagagctatgctggaaacagc

SEQ ID NO: 60044 - DNA, 70 bp, Artificial Sequence
  Synthetic
gccaagcatttaggtgacactataggggtggcgctcagaagatgtgtttcagagctatgctggaaacagc

SEQ ID NO: 60045 - DNA, 70 bp, Artificial Sequence
  Synthetic
gccaagcatttaggtgacactatagctctggaaagcacactgatggtttcagagctatgctggaaacagc

SEQ ID NO: 60046 - DNA, 70 bp, Artificial Sequence
  Synthetic
gccaagcatttaggtgacactataggatagtatgtgtcactctgcgtttcagagctatgctggaaacagc

SEQ ID NO: 60047 - DNA, 70 bp, Artificial Sequence
  Synthetic
gccaagcatttaggtgacactataggatttactctggcagctactgtttcagagctatgctggaaacagc

SEQ ID NO: 60048 - DNA, 70 bp, Artificial Sequence
  Synthetic
gccaagcatttaggtgacactatagactgcccagatatctactgagtttcagagctatgctggaaacagc

SEQ ID NO: 60049 - DNA, 70 bp, Artificial Sequence
  Synthetic
gccaagcatttaggtgacactatagtgctgtgacgaggctcacaggtttcagagctatgctggaaacagc

SEQ ID NO: 60050 - DNA, 70 bp, Artificial Sequence
  Synthetic
gccaagcatttaggtgacactatagaactggaccatcctgtcttagtttcagagctatgctggaaacagc

SEQ ID NO: 60051 - DNA, 70 bp, Artificial Sequence
  Synthetic
gccaagcatttaggtgacactataggccctcagggctcctatttggtttcagagctatgctggaaacagc

SEQ ID NO: 60052 - DNA, 70 bp, Artificial Sequence
  Synthetic
gccaagcatttaggtgacactatagagccctgttctttggtagacgtttcagagctatgctggaaacagc

SEQ ID NO: 60053 - DNA, 70 bp, Artificial Sequence
  Synthetic
gccaagcatttaggtgacactataggggccagggctaccagagcagtttcagagctatgctggaaacagc

SEQ ID NO: 60054 - DNA, 70 bp, Artificial Sequence
  Synthetic
gccaagcatttaggtgacactatagtgacttgaagcaaaatcagggtttcagagctatgctggaaacagc

SEQ ID NO: 60055 - DNA, 70 bp, Artificial Sequence
  Synthetic
gccaagcatttaggtgacactatagggtgctgccaagcattaggtgtttcagagctatgctggaaacagc

SEQ ID NO: 60056 - DNA, 70 bp, Artificial Sequence
  Synthetic
gccaagcatttaggtgacactataggcagtgctcctggggctcaggtttcagagctatgctggaaacagc

SEQ ID NO: 60057 - DNA, 70 bp, Artificial Sequence
  Synthetic
gccaagcatttaggtgacactataggagctggaggactagactccgtttcagagctatgctggaaacagc

SEQ ID NO: 60058 - DNA, 70 bp, Artificial Sequence
  Synthetic
gccaagcatttaggtgacactatagagaactttgagttttgtaccgtttcagagctatgctggaaacagc

SEQ ID NO: 60059 - DNA, 70 bp, Artificial Sequence
  Synthetic
gccaagcatttaggtgacactatagcagctataactcatccatcagtttcagagctatgctggaaacagc

SEQ ID NO: 60060 - DNA, 70 bp, Artificial Sequence
  Synthetic
gccaagcatttaggtgacactatagtgtacatcatttctgccatggtttcagagctatgctggaaacagc

SEQ ID NO: 60061 - DNA, 70 bp, Artificial Sequence
  Synthetic
gccaagcatttaggtgacactatagttgatcttattagtccctccgtttcagagctatgctggaaacagc

SEQ ID NO: 60062 - DNA, 70 bp, Artificial Sequence
  Synthetic
gccaagcatttaggtgacactatagtttgatatgtctactccaaggtttcagagctatgctggaaacagc

SEQ ID NO: 60063 - DNA, 70 bp, Artificial Sequence
  Synthetic
gccaagcatttaggtgacactatagggtctggccgagtgttaggggtttcagagctatgctggaaacagc

SEQ ID NO: 60064 - DNA, 70 bp, Artificial Sequence
  Synthetic
gccaagcatttaggtgacactatagttgaaagaggaggaggagatgtttcagagctatgctggaaacagc

SEQ ID NO: 60065 - DNA, 70 bp, Artificial Sequence
  Synthetic
gccaagcatttaggtgacactatagaggggtgctctcgaggctacgtttcagagctatgctggaaacagc

SEQ ID NO: 60066 - DNA, 70 bp, Artificial Sequence
  Synthetic
gccaagcatttaggtgacactatagggttagcagtagtgttcaccgtttcagagctatgctggaaacagc

SEQ ID NO: 60067 - DNA, 70 bp, Artificial Sequence
  Synthetic
gccaagcatttaggtgacactatagatagtaactccaactctcaggtttcagagctatgctggaaacagc

SEQ ID NO: 60068 - DNA, 70 bp, Artificial Sequence
  Synthetic
gccaagcatttaggtgacactataggtgaaacaaagacacgttaggtttcagagctatgctggaaacagc

SEQ ID NO: 60069 - DNA, 70 bp, Artificial Sequence
  Synthetic
gccaagcatttaggtgacactataggacgctacactcacaggtgagtttcagagctatgctggaaacagc

SEQ ID NO: 60070 - DNA, 70 bp, Artificial Sequence
  Synthetic
gccaagcatttaggtgacactatagcttctctagaagtcctgccggtttcagagctatgctggaaacagc

SEQ ID NO: 60071 - DNA, 70 bp, Artificial Sequence
  Synthetic
gccaagcatttaggtgacactatagggcgaaactgtgatctgcgggtttcagagctatgctggaaacagc

SEQ ID NO: 60072 - DNA, 70 bp, Artificial Sequence
  Synthetic
gccaagcatttaggtgacactatagtaggattaaggaagactctggtttcagagctatgctggaaacagc

SEQ ID NO: 60073 - DNA, 70 bp, Artificial Sequence
  Synthetic
gccaagcatttaggtgacactatagaaactgccgggctatctgatgtttcagagctatgctggaaacagc

SEQ ID NO: 60074 - DNA, 70 bp, Artificial Sequence
  Synthetic
gccaagcatttaggtgacactatagagattccttcttctgttcatgtttcagagctatgctggaaacagc

SEQ ID NO: 60075 - DNA, 70 bp, Artificial Sequence
  Synthetic
gccaagcatttaggtgacactatagcagtagctttcttggcctacgtttcagagctatgctggaaacagc

SEQ ID NO: 60076 - DNA, 70 bp, Artificial Sequence
  Synthetic
gccaagcatttaggtgacactatagttcatcatcgagatagtcctgtttcagagctatgctggaaacagc

SEQ ID NO: 60077 - DNA, 70 bp, Artificial Sequence
  Synthetic
gccaagcatttaggtgacactatagggtactggacttgagacgttgtttcagagctatgctggaaacagc

SEQ ID NO: 60078 - DNA, 70 bp, Artificial Sequence
  Synthetic
gccaagcatttaggtgacactatagaattggaatcaattagcctcgtttcagagctatgctggaaacagc

SEQ ID NO: 60079 - DNA, 70 bp, Artificial Sequence
  Synthetic
gccaagcatttaggtgacactatagaatttaggcttctggagctggtttcagagctatgctggaaacagc

SEQ ID NO: 60080 - DNA, 70 bp, Artificial Sequence
  Synthetic
gccaagcatttaggtgacactatagggccaagctcctgtggtgaggtttcagagctatgctggaaacagc

SEQ ID NO: 60081 - DNA, 70 bp, Artificial Sequence
  Synthetic
gccaagcatttaggtgacactatagaaaagctccttggggcatgagtttcagagctatgctggaaacagc

SEQ ID NO: 60082 - DNA, 70 bp, Artificial Sequence
  Synthetic
gccaagcatttaggtgacactataggccactgggctcaggccccggtttcagagctatgctggaaacagc

SEQ ID NO: 60083 - DNA, 70 bp, Artificial Sequence
  Synthetic
gccaagcatttaggtgacactatagccaccgactgtgcctgccaggtttcagagctatgctggaaacagc

SEQ ID NO: 60084 - DNA, 70 bp, Artificial Sequence
  Synthetic
gccaagcatttaggtgacactatagacccaagggtttaattccacgtttcagagctatgctggaaacagc

SEQ ID NO: 60085 - DNA, 70 bp, Artificial Sequence
  Synthetic
gccaagcatttaggtgacactatagttgtacccagaggaaacttcgtttcagagctatgctggaaacagc

SEQ ID NO: 60086 - DNA, 70 bp, Artificial Sequence
  Synthetic
gccaagcatttaggtgacactatagtcttacaatagacctcaaaggtttcagagctatgctggaaacagc

SEQ ID NO: 60087 - DNA, 70 bp, Artificial Sequence
  Synthetic
gccaagcatttaggtgacactataggaggtctacgtgctgtcctggtttcagagctatgctggaaacagc

SEQ ID NO: 60088 - DNA, 70 bp, Artificial Sequence
  Synthetic
gccaagcatttaggtgacactataggaggtctacctgggggcctggtttcagagctatgctggaaacagc

SEQ ID NO: 60089 - DNA, 70 bp, Artificial Sequence
  Synthetic
gccaagcatttaggtgacactatagtaccaaggaagttcccaccagtttcagagctatgctggaaacagc

SEQ ID NO: 60090 - DNA, 70 bp, Artificial Sequence
  Synthetic
gccaagcatttaggtgacactatagtccctatcaggaggactgaagtttcagagctatgctggaaacagc

SEQ ID NO: 60091 - DNA, 70 bp, Artificial Sequence
  Synthetic
gccaagcatttaggtgacactatagctgtgtgctctagcgccttggtttcagagctatgctggaaacagc

SEQ ID NO: 60092 - DNA, 70 bp, Artificial Sequence
  Synthetic
gccaagcatttaggtgacactatagggagccagccctatttgtaggtttcagagctatgctggaaacagc

SEQ ID NO: 60093 - DNA, 70 bp, Artificial Sequence
  Synthetic
gccaagcatttaggtgacactatagaatgtttatcggctgcataagtttcagagctatgctggaaacagc

SEQ ID NO: 60094 - DNA, 70 bp, Artificial Sequence
  Synthetic
gccaagcatttaggtgacactatagcgaagaacttgccaaatctagtttcagagctatgctggaaacagc

SEQ ID NO: 60095 - DNA, 70 bp, Artificial Sequence
  Synthetic
gccaagcatttaggtgacactatagaaagagtcagatgttgagaggtttcagagctatgctggaaacagc

SEQ ID NO: 60096 - DNA, 70 bp, Artificial Sequence
  Synthetic
gccaagcatttaggtgacactatagataggggacagcacacttgagtttcagagctatgctggaaacagc

SEQ ID NO: 60097 - DNA, 70 bp, Artificial Sequence
  Synthetic
gccaagcatttaggtgacactatagtgtgatggaactagacacgtgtttcagagctatgctggaaacagc

SEQ ID NO: 60098 - DNA, 70 bp, Artificial Sequence
  Synthetic
gccaagcatttaggtgacactatagcgcccccagacaagagttgagtttcagagctatgctggaaacagc

SEQ ID NO: 60099 - DNA, 70 bp, Artificial Sequence
  Synthetic
gccaagcatttaggtgacactatagctcagcgccttggggcctacgtttcagagctatgctggaaacagc

SEQ ID NO: 60100 - DNA, 70 bp, Artificial Sequence
  Synthetic
gccaagcatttaggtgacactatagttataattcggttacacggtgtttcagagctatgctggaaacagc

SEQ ID NO: 60101 - DNA, 70 bp, Artificial Sequence
  Synthetic
gccaagcatttaggtgacactataggcgcggggcccggccctgaggtttcagagctatgctggaaacagc

SEQ ID NO: 60102 - DNA, 70 bp, Artificial Sequence
  Synthetic
gccaagcatttaggtgacactataggtgcacaggtgtgcttctaagtttcagagctatgctggaaacagc

SEQ ID NO: 60103 - DNA, 70 bp, Artificial Sequence
  Synthetic
gccaagcatttaggtgacactatagctggtgcacaggttctgaacgtttcagagctatgctggaaacagc

SEQ ID NO: 60104 - DNA, 70 bp, Artificial Sequence
  Synthetic
gccaagcatttaggtgacactatagagcatgcgtctctcatagacgtttcagagctatgctggaaacagc

SEQ ID NO: 60105 - DNA, 70 bp, Artificial Sequence
  Synthetic
gccaagcatttaggtgacactatagattcctgggctcacaagaccgtttcagagctatgctggaaacagc

SEQ ID NO: 60106 - DNA, 70 bp, Artificial Sequence
  Synthetic
gccaagcatttaggtgacactatagctacaggtcttcacaaaaccgtttcagagctatgctggaaacagc

SEQ ID NO: 60107 - DNA, 70 bp, Artificial Sequence
  Synthetic
gccaagcatttaggtgacactatagtgatctttcactctgcaaacgtttcagagctatgctggaaacagc

SEQ ID NO: 60108 - DNA, 70 bp, Artificial Sequence
  Synthetic
gccaagcatttaggtgacactataggtttacgaaggatttggaccgtttcagagctatgctggaaacagc

SEQ ID NO: 60109 - DNA, 70 bp, Artificial Sequence
  Synthetic
gccaagcatttaggtgacactatagagaggatgaatcaatgtttcgtttcagagctatgctggaaacagc

SEQ ID NO: 60110 - DNA, 70 bp, Artificial Sequence
  Synthetic
gccaagcatttaggtgacactatagaatcccagaaaactctgctggtttcagagctatgctggaaacagc

SEQ ID NO: 60111 - DNA, 70 bp, Artificial Sequence
  Synthetic
gccaagcatttaggtgacactatagccagggctcgagccactcacgtttcagagctatgctggaaacagc

SEQ ID NO: 60112 - DNA, 70 bp, Artificial Sequence
  Synthetic
gccaagcatttaggtgacactataggaggaggaggagaggaagtggtttcagagctatgctggaaacagc

SEQ ID NO: 60113 - DNA, 70 bp, Artificial Sequence
  Synthetic
gccaagcatttaggtgacactatagctgcaccgcgcagcctgatagtttcagagctatgctggaaacagc

SEQ ID NO: 60114 - DNA, 70 bp, Artificial Sequence
  Synthetic
gccaagcatttaggtgacactatagtatccctggcacgacacactgtttcagagctatgctggaaacagc

SEQ ID NO: 60115 - DNA, 70 bp, Artificial Sequence
  Synthetic
gccaagcatttaggtgacactatagcaatttgcgatctgctgcatgtttcagagctatgctggaaacagc

SEQ ID NO: 60116 - DNA, 70 bp, Artificial Sequence
  Synthetic
gccaagcatttaggtgacactataggcagcaggtggcaccctgacgtttcagagctatgctggaaacagc

SEQ ID NO: 60117 - DNA, 70 bp, Artificial Sequence
  Synthetic
gccaagcatttaggtgacactatagaaggctcctcccagggctgagtttcagagctatgctggaaacagc

SEQ ID NO: 60118 - DNA, 70 bp, Artificial Sequence
  Synthetic
gccaagcatttaggtgacactatagcagtgagatgcaaagtaagcgtttcagagctatgctggaaacagc

SEQ ID NO: 60119 - DNA, 70 bp, Artificial Sequence
  Synthetic
gccaagcatttaggtgacactatagcggctgcacaccaggtgcgggtttcagagctatgctggaaacagc

SEQ ID NO: 60120 - DNA, 70 bp, Artificial Sequence
  Synthetic
gccaagcatttaggtgacactatagcttcctctcccaaggctaaggtttcagagctatgctggaaacagc

SEQ ID NO: 60121 - DNA, 70 bp, Artificial Sequence
  Synthetic
gccaagcatttaggtgacactatagctttgagaagtggtggtagggtttcagagctatgctggaaacagc

SEQ ID NO: 60122 - DNA, 70 bp, Artificial Sequence
  Synthetic
gccaagcatttaggtgacactatagaagcccagatttcaatatctgtttcagagctatgctggaaacagc

SEQ ID NO: 60123 - DNA, 70 bp, Artificial Sequence
  Synthetic
gccaagcatttaggtgacactatagaatgcaacactttgtattgcgtttcagagctatgctggaaacagc

SEQ ID NO: 60124 - DNA, 70 bp, Artificial Sequence
  Synthetic
gccaagcatttaggtgacactatagtggtttagctgatgctgagcgtttcagagctatgctggaaacagc

SEQ ID NO: 60125 - DNA, 70 bp, Artificial Sequence
  Synthetic
gccaagcatttaggtgacactataggagccatcaagtttcagcgcgtttcagagctatgctggaaacagc

SEQ ID NO: 60126 - DNA, 70 bp, Artificial Sequence
  Synthetic
gccaagcatttaggtgacactatagctggctggtgggtcacgccggtttcagagctatgctggaaacagc

SEQ ID NO: 60127 - DNA, 70 bp, Artificial Sequence
  Synthetic
gccaagcatttaggtgacactatagtgggcctgcaggagaacatggtttcagagctatgctggaaacagc

SEQ ID NO: 60128 - DNA, 70 bp, Artificial Sequence
  Synthetic
gccaagcatttaggtgacactatagacccacagaccccaaaggttgtttcagagctatgctggaaacagc

SEQ ID NO: 60129 - DNA, 70 bp, Artificial Sequence
  Synthetic
gccaagcatttaggtgacactatagagctgtggccagattaataagtttcagagctatgctggaaacagc

SEQ ID NO: 60130 - DNA, 70 bp, Artificial Sequence
  Synthetic
gccaagcatttaggtgacactataggccctggaaagaggccctaggtttcagagctatgctggaaacagc

SEQ ID NO: 60131 - DNA, 70 bp, Artificial Sequence
  Synthetic
gccaagcatttaggtgacactatagaggtgtggggtaggcctcacgtttcagagctatgctggaaacagc

SEQ ID NO: 60132 - DNA, 70 bp, Artificial Sequence
  Synthetic
gccaagcatttaggtgacactatagcatcaccccagagaaatttcgtttcagagctatgctggaaacagc

SEQ ID NO: 60133 - DNA, 70 bp, Artificial Sequence
  Synthetic
gccaagcatttaggtgacactatagcacagctcctggagccccacgtttcagagctatgctggaaacagc

SEQ ID NO: 60134 - DNA, 70 bp, Artificial Sequence
  Synthetic
gccaagcatttaggtgacactatagaaccagcagggaacggctacgtttcagagctatgctggaaacagc

SEQ ID NO: 60135 - DNA, 70 bp, Artificial Sequence
  Synthetic
gccaagcatttaggtgacactataggactgtctgctggggttcaagtttcagagctatgctggaaacagc

SEQ ID NO: 60136 - DNA, 70 bp, Artificial Sequence
  Synthetic
gccaagcatttaggtgacactatagcacggtgcctggcttcagtagtttcagagctatgctggaaacagc

SEQ ID NO: 60137 - DNA, 70 bp, Artificial Sequence
  Synthetic
gccaagcatttaggtgacactatagggagattcttgtgccttcacgtttcagagctatgctggaaacagc

SEQ ID NO: 60138 - DNA, 70 bp, Artificial Sequence
  Synthetic
gccaagcatttaggtgacactataggagagtggttcatcaatgatgtttcagagctatgctggaaacagc

SEQ ID NO: 60139 - DNA, 70 bp, Artificial Sequence
  Synthetic
gccaagcatttaggtgacactatagcgtgagctgagccaatgatggtttcagagctatgctggaaacagc

SEQ ID NO: 60140 - DNA, 70 bp, Artificial Sequence
  Synthetic
gccaagcatttaggtgacactatagtacattggagtctcttcattgtttcagagctatgctggaaacagc

SEQ ID NO: 60141 - DNA, 70 bp, Artificial Sequence
  Synthetic
gccaagcatttaggtgacactatagtatgtacagttgtcagcctagtttcagagctatgctggaaacagc

SEQ ID NO: 60142 - DNA, 70 bp, Artificial Sequence
  Synthetic
gccaagcatttaggtgacactatagaggtcattctgagcttttaagtttcagagctatgctggaaacagc

SEQ ID NO: 60143 - DNA, 70 bp, Artificial Sequence
  Synthetic
gccaagcatttaggtgacactatagcactaaggacattcggctgtgtttcagagctatgctggaaacagc

SEQ ID NO: 60144 - DNA, 70 bp, Artificial Sequence
  Synthetic
gccaagcatttaggtgacactatagagggcagatagattgtaacagtttcagagctatgctggaaacagc

SEQ ID NO: 60145 - DNA, 70 bp, Artificial Sequence
  Synthetic
gccaagcatttaggtgacactatagacagccaaatggcagaggcagtttcagagctatgctggaaacagc

SEQ ID NO: 60146 - DNA, 70 bp, Artificial Sequence
  Synthetic
gccaagcatttaggtgacactatagagaacacactctcctgcctcgtttcagagctatgctggaaacagc

SEQ ID NO: 60147 - DNA, 70 bp, Artificial Sequence
  Synthetic
gccaagcatttaggtgacactatagacgctgtcatagctcatcctgtttcagagctatgctggaaacagc

SEQ ID NO: 60148 - DNA, 70 bp, Artificial Sequence
  Synthetic
gccaagcatttaggtgacactatagcagggtgcaggcagatgaccgtttcagagctatgctggaaacagc

SEQ ID NO: 60149 - DNA, 70 bp, Artificial Sequence
  Synthetic
gccaagcatttaggtgacactatagtctctcagctgctacttcccgtttcagagctatgctggaaacagc

SEQ ID NO: 60150 - DNA, 70 bp, Artificial Sequence
  Synthetic
gccaagcatttaggtgacactatagttctggatcaagaacagcaagtttcagagctatgctggaaacagc

SEQ ID NO: 60151 - DNA, 70 bp, Artificial Sequence
  Synthetic
gccaagcatttaggtgacactatagggttcgggaggagctgtgaggtttcagagctatgctggaaacagc

SEQ ID NO: 60152 - DNA, 70 bp, Artificial Sequence
  Synthetic
gccaagcatttaggtgacactataggagcctgaactcgcatgagagtttcagagctatgctggaaacagc

SEQ ID NO: 60153 - DNA, 70 bp, Artificial Sequence
  Synthetic
gccaagcatttaggtgacactatagaccttgtacgttgtcagaatgtttcagagctatgctggaaacagc

SEQ ID NO: 60154 - DNA, 70 bp, Artificial Sequence
  Synthetic
gccaagcatttaggtgacactatagtcaacttctgttgatccacagtttcagagctatgctggaaacagc

SEQ ID NO: 60155 - DNA, 70 bp, Artificial Sequence
  Synthetic
gccaagcatttaggtgacactatagctgccaacagttcagtcttcgtttcagagctatgctggaaacagc

SEQ ID NO: 60156 - DNA, 70 bp, Artificial Sequence
  Synthetic
gccaagcatttaggtgacactatagtgtacattctcagtgtccccgtttcagagctatgctggaaacagc

SEQ ID NO: 60157 - DNA, 70 bp, Artificial Sequence
  Synthetic
gccaagcatttaggtgacactatagagcagaggagccagacatgggtttcagagctatgctggaaacagc

SEQ ID NO: 60158 - DNA, 70 bp, Artificial Sequence
  Synthetic
gccaagcatttaggtgacactatagatgcgcgcgtggaactctgagtttcagagctatgctggaaacagc

SEQ ID NO: 60159 - DNA, 70 bp, Artificial Sequence
  Synthetic
gccaagcatttaggtgacactatagaatgaagctggggactgagggtttcagagctatgctggaaacagc

SEQ ID NO: 60160 - DNA, 70 bp, Artificial Sequence
  Synthetic
gccaagcatttaggtgacactatagtgctctttccaagaagtcaggtttcagagctatgctggaaacagc

SEQ ID NO: 60161 - DNA, 70 bp, Artificial Sequence
  Synthetic
gccaagcatttaggtgacactatagttaaacagttggaacaccgggtttcagagctatgctggaaacagc

SEQ ID NO: 60162 - DNA, 70 bp, Artificial Sequence
  Synthetic
gccaagcatttaggtgacactatagtttcagtgcatgtacgccttgtttcagagctatgctggaaacagc

SEQ ID NO: 60163 - DNA, 70 bp, Artificial Sequence
  Synthetic
gccaagcatttaggtgacactatagcctgggatgtcttcatcgcagtttcagagctatgctggaaacagc

SEQ ID NO: 60164 - DNA, 70 bp, Artificial Sequence
  Synthetic
gccaagcatttaggtgacactatagaaagcagttaacagtgctacgtttcagagctatgctggaaacagc

SEQ ID NO: 60165 - DNA, 70 bp, Artificial Sequence
  Synthetic
gccaagcatttaggtgacactatagtcggtttttccttgtctaaggtttcagagctatgctggaaacagc

SEQ ID NO: 60166 - DNA, 70 bp, Artificial Sequence
  Synthetic
gccaagcatttaggtgacactatagtgccttggcccagagacactgtttcagagctatgctggaaacagc

SEQ ID NO: 60167 - DNA, 70 bp, Artificial Sequence
  Synthetic
gccaagcatttaggtgacactatagttattctcagcacctgcgccgtttcagagctatgctggaaacagc

SEQ ID NO: 60168 - DNA, 70 bp, Artificial Sequence
  Synthetic
gccaagcatttaggtgacactataggccgggctagagcgacatcagtttcagagctatgctggaaacagc

SEQ ID NO: 60169 - DNA, 70 bp, Artificial Sequence
  Synthetic
gccaagcatttaggtgacactatagatcgggtcttccctttaatagtttcagagctatgctggaaacagc

SEQ ID NO: 60170 - DNA, 70 bp, Artificial Sequence
  Synthetic
gccaagcatttaggtgacactatagcccagcccctctctcaaaatgtttcagagctatgctggaaacagc

SEQ ID NO: 60171 - DNA, 70 bp, Artificial Sequence
  Synthetic
gccaagcatttaggtgacactataggtttagcaagcaagactcgtgtttcagagctatgctggaaacagc

SEQ ID NO: 60172 - DNA, 70 bp, Artificial Sequence
  Synthetic
gccaagcatttaggtgacactatagaaagctgttactggctgttagtttcagagctatgctggaaacagc

SEQ ID NO: 60173 - DNA, 70 bp, Artificial Sequence
  Synthetic
gccaagcatttaggtgacactatagctcccttcttcaacagcatagtttcagagctatgctggaaacagc

SEQ ID NO: 60174 - DNA, 70 bp, Artificial Sequence
  Synthetic
gccaagcatttaggtgacactatagctgggagacagggcctcagggtttcagagctatgctggaaacagc

SEQ ID NO: 60175 - DNA, 70 bp, Artificial Sequence
  Synthetic
gccaagcatttaggtgacactatagccctggtgggtggggctagagtttcagagctatgctggaaacagc

SEQ ID NO: 60176 - DNA, 70 bp, Artificial Sequence
  Synthetic
gccaagcatttaggtgacactatagactacgtggaggctatctaggtttcagagctatgctggaaacagc

SEQ ID NO: 60177 - DNA, 70 bp, Artificial Sequence
  Synthetic
gccaagcatttaggtgacactataggcctgtccccgactcatcacgtttcagagctatgctggaaacagc

SEQ ID NO: 60178 - DNA, 70 bp, Artificial Sequence
  Synthetic
gccaagcatttaggtgacactataggccaactacgtggagtgtgtgtttcagagctatgctggaaacagc

SEQ ID NO: 60179 - DNA, 70 bp, Artificial Sequence
  Synthetic
gccaagcatttaggtgacactatagtcccttcaaatggtggaacagtttcagagctatgctggaaacagc

SEQ ID NO: 60180 - DNA, 70 bp, Artificial Sequence
  Synthetic
gccaagcatttaggtgacactatagagcccttcaccttcaagtgggtttcagagctatgctggaaacagc

SEQ ID NO: 60181 - DNA, 70 bp, Artificial Sequence
  Synthetic
gccaagcatttaggtgacactatagctctttcaagtggtggaacagtttcagagctatgctggaaacagc

SEQ ID NO: 60182 - DNA, 70 bp, Artificial Sequence
  Synthetic
gccaagcatttaggtgacactatagctccttcaagtggtggaacagtttcagagctatgctggaaacagc

SEQ ID NO: 60183 - DNA, 70 bp, Artificial Sequence
  Synthetic
gccaagcatttaggtgacactatagtgccttcaaatggtggaagagtttcagagctatgctggaaacagc

SEQ ID NO: 60184 - DNA, 70 bp, Artificial Sequence
  Synthetic
gccaagcatttaggtgacactatagcttgctggacttgaaacagagtttcagagctatgctggaaacagc

SEQ ID NO: 60185 - DNA, 70 bp, Artificial Sequence
  Synthetic
gccaagcatttaggtgacactatagggcaggagctcacctagaaagtttcagagctatgctggaaacagc

SEQ ID NO: 60186 - DNA, 70 bp, Artificial Sequence
  Synthetic
gccaagcatttaggtgacactatagactgtcactatcagcttcacgtttcagagctatgctggaaacagc

SEQ ID NO: 60187 - DNA, 70 bp, Artificial Sequence
  Synthetic
gccaagcatttaggtgacactataggcagcaaagcacttttctaggtttcagagctatgctggaaacagc

SEQ ID NO: 60188 - DNA, 70 bp, Artificial Sequence
  Synthetic
gccaagcatttaggtgacactataggccgaaggagacacaatcaagtttcagagctatgctggaaacagc

SEQ ID NO: 60189 - DNA, 70 bp, Artificial Sequence
  Synthetic
gccaagcatttaggtgacactatagacaaaccaccattgcctgacgtttcagagctatgctggaaacagc

SEQ ID NO: 60190 - DNA, 70 bp, Artificial Sequence
  Synthetic
gccaagcatttaggtgacactatagagaaaagtccagatggactggtttcagagctatgctggaaacagc

SEQ ID NO: 60191 - DNA, 70 bp, Artificial Sequence
  Synthetic
gccaagcatttaggtgacactatagcaagtttggagaatcagtgtgtttcagagctatgctggaaacagc

SEQ ID NO: 60192 - DNA, 70 bp, Artificial Sequence
  Synthetic
gccaagcatttaggtgacactatagtatcaacacaaggcagccacgtttcagagctatgctggaaacagc

SEQ ID NO: 60193 - DNA, 70 bp, Artificial Sequence
  Synthetic
gccaagcatttaggtgacactataggcagcaggatgcttagggtggtttcagagctatgctggaaacagc

SEQ ID NO: 60194 - DNA, 70 bp, Artificial Sequence
  Synthetic
gccaagcatttaggtgacactatagaaatggccagttgtgcctacgtttcagagctatgctggaaacagc

SEQ ID NO: 60195 - DNA, 70 bp, Artificial Sequence
  Synthetic
gccaagcatttaggtgacactatagtcttctgggttgctagagccgtttcagagctatgctggaaacagc

SEQ ID NO: 60196 - DNA, 70 bp, Artificial Sequence
  Synthetic
gccaagcatttaggtgacactatagagaggaggtgaaaacacctggtttcagagctatgctggaaacagc

SEQ ID NO: 60197 - DNA, 70 bp, Artificial Sequence
  Synthetic
gccaagcatttaggtgacactatagctcactaaagtgctggaagcgtttcagagctatgctggaaacagc

SEQ ID NO: 60198 - DNA, 70 bp, Artificial Sequence
  Synthetic
gccaagcatttaggtgacactatagcctgttaaaataccagaagcgtttcagagctatgctggaaacagc

SEQ ID NO: 60199 - DNA, 70 bp, Artificial Sequence
  Synthetic
gccaagcatttaggtgacactatagcatgctaagactaaagaagcgtttcagagctatgctggaaacagc

SEQ ID NO: 60200 - DNA, 70 bp, Artificial Sequence
  Synthetic
gccaagcatttaggtgacactatagcccactaaagtgctggaagcgtttcagagctatgctggaaacagc

SEQ ID NO: 60201 - DNA, 70 bp, Artificial Sequence
  Synthetic
gccaagcatttaggtgacactataggtagtctcttccctcggcaggtttcagagctatgctggaaacagc

SEQ ID NO: 60202 - DNA, 70 bp, Artificial Sequence
  Synthetic
gccaagcatttaggtgacactatagttttctggagggcactgcaagtttcagagctatgctggaaacagc

SEQ ID NO: 60203 - DNA, 70 bp, Artificial Sequence
  Synthetic
gccaagcatttaggtgacactatagcacatggatttccttgaagcgtttcagagctatgctggaaacagc

SEQ ID NO: 60204 - DNA, 70 bp, Artificial Sequence
  Synthetic
gccaagcatttaggtgacactatagtcataagcttcttctatctcgtttcagagctatgctggaaacagc

SEQ ID NO: 60205 - DNA, 70 bp, Artificial Sequence
  Synthetic
gccaagcatttaggtgacactatagtttgttcctggggtgaagtagtttcagagctatgctggaaacagc

SEQ ID NO: 60206 - DNA, 70 bp, Artificial Sequence
  Synthetic
gccaagcatttaggtgacactatagtcggctcagtacttctctccgtttcagagctatgctggaaacagc

SEQ ID NO: 60207 - DNA, 70 bp, Artificial Sequence
  Synthetic
gccaagcatttaggtgacactatagactgattgctgcagctaagggtttcagagctatgctggaaacagc

SEQ ID NO: 60208 - DNA, 70 bp, Artificial Sequence
  Synthetic
gccaagcatttaggtgacactatagatcaaccaagaagaggaaaagtttcagagctatgctggaaacagc

SEQ ID NO: 60209 - DNA, 70 bp, Artificial Sequence
  Synthetic
gccaagcatttaggtgacactatagggccacagcagtgatgttaagtttcagagctatgctggaaacagc

SEQ ID NO: 60210 - DNA, 70 bp, Artificial Sequence
  Synthetic
gccaagcatttaggtgacactatagtgtaaggcttgcagtcttaggtttcagagctatgctggaaacagc

SEQ ID NO: 60211 - DNA, 70 bp, Artificial Sequence
  Synthetic
gccaagcatttaggtgacactataggaagggcgctgggcctcatcgtttcagagctatgctggaaacagc

SEQ ID NO: 60212 - DNA, 70 bp, Artificial Sequence
  Synthetic
gccaagcatttaggtgacactatagtccccctcatgagacaatacgtttcagagctatgctggaaacagc

SEQ ID NO: 60213 - DNA, 70 bp, Artificial Sequence
  Synthetic
gccaagcatttaggtgacactatagatacttggggtgggctcagcgtttcagagctatgctggaaacagc

SEQ ID NO: 60214 - DNA, 70 bp, Artificial Sequence
  Synthetic
gccaagcatttaggtgacactatagggggtgggctcagcaggtgggtttcagagctatgctggaaacagc

SEQ ID NO: 60215 - DNA, 70 bp, Artificial Sequence
  Synthetic
gccaagcatttaggtgacactatagttgctggctggacaaaaagagtttcagagctatgctggaaacagc

SEQ ID NO: 60216 - DNA, 70 bp, Artificial Sequence
  Synthetic
gccaagcatttaggtgacactatagccccgaggacttgctgtagggtttcagagctatgctggaaacagc

SEQ ID NO: 60217 - DNA, 70 bp, Artificial Sequence
  Synthetic
gccaagcatttaggtgacactatagtaacaagaatgctggattacgtttcagagctatgctggaaacagc

SEQ ID NO: 60218 - DNA, 70 bp, Artificial Sequence
  Synthetic
gccaagcatttaggtgacactatagtgtgtcctgtactgccaggcgtttcagagctatgctggaaacagc

SEQ ID NO: 60219 - DNA, 70 bp, Artificial Sequence
  Synthetic
gccaagcatttaggtgacactatagtgctgctccatcatgtgagcgtttcagagctatgctggaaacagc

SEQ ID NO: 60220 - DNA, 70 bp, Artificial Sequence
  Synthetic
gccaagcatttaggtgacactatagattgacagcgctttttctttgtttcagagctatgctggaaacagc

SEQ ID NO: 60221 - DNA, 70 bp, Artificial Sequence
  Synthetic
gccaagcatttaggtgacactatagattcgttgtcttcttcctccgtttcagagctatgctggaaacagc

SEQ ID NO: 60222 - DNA, 70 bp, Artificial Sequence
  Synthetic
gccaagcatttaggtgacactatagaaagacgtgccagtgttgtggtttcagagctatgctggaaacagc

SEQ ID NO: 60223 - DNA, 70 bp, Artificial Sequence
  Synthetic
gccaagcatttaggtgacactatagaatggcaaagctgggaaaaagtttcagagctatgctggaaacagc

SEQ ID NO: 60224 - DNA, 70 bp, Artificial Sequence
  Synthetic
gccaagcatttaggtgacactatagatcaaagcttggttttcagggtttcagagctatgctggaaacagc

SEQ ID NO: 60225 - DNA, 70 bp, Artificial Sequence
  Synthetic
gccaagcatttaggtgacactataggggagccgagcagtcacgtagtttcagagctatgctggaaacagc

SEQ ID NO: 60226 - DNA, 70 bp, Artificial Sequence
  Synthetic
gccaagcatttaggtgacactatagaggtgctgccttttaaagacgtttcagagctatgctggaaacagc

SEQ ID NO: 60227 - DNA, 70 bp, Artificial Sequence
  Synthetic
gccaagcatttaggtgacactatagagctgtcttctcctcagtgcgtttcagagctatgctggaaacagc

SEQ ID NO: 60228 - DNA, 70 bp, Artificial Sequence
  Synthetic
gccaagcatttaggtgacactataggaactgattgcagctgcaaagtttcagagctatgctggaaacagc

SEQ ID NO: 60229 - DNA, 70 bp, Artificial Sequence
  Synthetic
gccaagcatttaggtgacactatagtggagccgttggggcactgtgtttcagagctatgctggaaacagc

SEQ ID NO: 60230 - DNA, 70 bp, Artificial Sequence
  Synthetic
gccaagcatttaggtgacactatagcctccccaggtaatgatcacgtttcagagctatgctggaaacagc

SEQ ID NO: 60231 - DNA, 70 bp, Artificial Sequence
  Synthetic
gccaagcatttaggtgacactatagtggagcgtacaaatttgagcgtttcagagctatgctggaaacagc

SEQ ID NO: 60232 - DNA, 70 bp, Artificial Sequence
  Synthetic
gccaagcatttaggtgacactataggagcagttggtgcacttcttgtttcagagctatgctggaaacagc

SEQ ID NO: 60233 - DNA, 70 bp, Artificial Sequence
  Synthetic
gccaagcatttaggtgacactatagggcagctgcagcgcctcactgtttcagagctatgctggaaacagc

SEQ ID NO: 60234 - DNA, 70 bp, Artificial Sequence
  Synthetic
gccaagcatttaggtgacactatagcgctcggccagcacctaggcgtttcagagctatgctggaaacagc

SEQ ID NO: 60235 - DNA, 70 bp, Artificial Sequence
  Synthetic
gccaagcatttaggtgacactataggaatgcccgacagagacttcgtttcagagctatgctggaaacagc

SEQ ID NO: 60236 - DNA, 70 bp, Artificial Sequence
  Synthetic
gccaagcatttaggtgacactatagacagtactcacgaccgttctgtttcagagctatgctggaaacagc

SEQ ID NO: 60237 - DNA, 70 bp, Artificial Sequence
  Synthetic
gccaagcatttaggtgacactatagtgagtactgtggagttttgagtttcagagctatgctggaaacagc

SEQ ID NO: 60238 - DNA, 70 bp, Artificial Sequence
  Synthetic
gccaagcatttaggtgacactataggtgttcatcacatgccgagtgtttcagagctatgctggaaacagc

SEQ ID NO: 60239 - DNA, 70 bp, Artificial Sequence
  Synthetic
gccaagcatttaggtgacactatagtgtgtctcacccaagtgctcgtttcagagctatgctggaaacagc

SEQ ID NO: 60240 - DNA, 70 bp, Artificial Sequence
  Synthetic
gccaagcatttaggtgacactatagcccaggcccaggctctagctgtttcagagctatgctggaaacagc

SEQ ID NO: 60241 - DNA, 70 bp, Artificial Sequence
  Synthetic
gccaagcatttaggtgacactatagtcttctgacagatttcagtcgtttcagagctatgctggaaacagc

SEQ ID NO: 60242 - DNA, 70 bp, Artificial Sequence
  Synthetic
gccaagcatttaggtgacactatagtgctgtcctgaaaagataacgtttcagagctatgctggaaacagc

SEQ ID NO: 60243 - DNA, 70 bp, Artificial Sequence
  Synthetic
gccaagcatttaggtgacactataggcagcgctgactatctacaggtttcagagctatgctggaaacagc

SEQ ID NO: 60244 - DNA, 70 bp, Artificial Sequence
  Synthetic
gccaagcatttaggtgacactatagccgtgagcctcagcagataagtttcagagctatgctggaaacagc

SEQ ID NO: 60245 - DNA, 70 bp, Artificial Sequence
  Synthetic
gccaagcatttaggtgacactataggctcagcccatctggcagtagtttcagagctatgctggaaacagc

SEQ ID NO: 60246 - DNA, 70 bp, Artificial Sequence
  Synthetic
gccaagcatttaggtgacactatagtgaagtacacaaaaggaagtgtttcagagctatgctggaaacagc

SEQ ID NO: 60247 - DNA, 70 bp, Artificial Sequence
  Synthetic
gccaagcatttaggtgacactatagagagttgatgctattgcattgtttcagagctatgctggaaacagc

SEQ ID NO: 60248 - DNA, 70 bp, Artificial Sequence
  Synthetic
gccaagcatttaggtgacactatagataacaggaataggatttgcgtttcagagctatgctggaaacagc

SEQ ID NO: 60249 - DNA, 70 bp, Artificial Sequence
  Synthetic
gccaagcatttaggtgacactatagatcctctagactccaactatgtttcagagctatgctggaaacagc

SEQ ID NO: 60250 - DNA, 70 bp, Artificial Sequence
  Synthetic
gccaagcatttaggtgacactatagggcactgcttttaccgattagtttcagagctatgctggaaacagc

SEQ ID NO: 60251 - DNA, 70 bp, Artificial Sequence
  Synthetic
gccaagcatttaggtgacactatagcggggatacagccatggctagtttcagagctatgctggaaacagc

SEQ ID NO: 60252 - DNA, 70 bp, Artificial Sequence
  Synthetic
gccaagcatttaggtgacactatagtccaccctcccagctctcaagtttcagagctatgctggaaacagc

SEQ ID NO: 60253 - DNA, 70 bp, Artificial Sequence
  Synthetic
gccaagcatttaggtgacactatagttactgattttcttctgcctgtttcagagctatgctggaaacagc

SEQ ID NO: 60254 - DNA, 70 bp, Artificial Sequence
  Synthetic
gccaagcatttaggtgacactatagcaaatccttggagaaagcttgtttcagagctatgctggaaacagc

SEQ ID NO: 60255 - DNA, 70 bp, Artificial Sequence
  Synthetic
gccaagcatttaggtgacactatagcaaaggcttagttcttctccgtttcagagctatgctggaaacagc

SEQ ID NO: 60256 - DNA, 70 bp, Artificial Sequence
  Synthetic
gccaagcatttaggtgacactatagtgtgaaacatagtcaggacagtttcagagctatgctggaaacagc

SEQ ID NO: 60257 - DNA, 70 bp, Artificial Sequence
  Synthetic
gccaagcatttaggtgacactatagctggcatggcagctcagtccgtttcagagctatgctggaaacagc

SEQ ID NO: 60258 - DNA, 70 bp, Artificial Sequence
  Synthetic
gccaagcatttaggtgacactatagatttctcagctgctctgtatgtttcagagctatgctggaaacagc

SEQ ID NO: 60259 - DNA, 70 bp, Artificial Sequence
  Synthetic
gccaagcatttaggtgacactatagacccaggccaaacaacagtggtttcagagctatgctggaaacagc

SEQ ID NO: 60260 - DNA, 70 bp, Artificial Sequence
  Synthetic
gccaagcatttaggtgacactatagatataggggcatcttcagccgtttcagagctatgctggaaacagc

SEQ ID NO: 60261 - DNA, 70 bp, Artificial Sequence
  Synthetic
gccaagcatttaggtgacactataggatcagaagaccaagtgaaggtttcagagctatgctggaaacagc

SEQ ID NO: 60262 - DNA, 70 bp, Artificial Sequence
  Synthetic
gccaagcatttaggtgacactatagctgaccaagaaagattcctggtttcagagctatgctggaaacagc

SEQ ID NO: 60263 - DNA, 70 bp, Artificial Sequence
  Synthetic
gccaagcatttaggtgacactatagtgcagaattcggagctgtttgtttcagagctatgctggaaacagc

SEQ ID NO: 60264 - DNA, 70 bp, Artificial Sequence
  Synthetic
gccaagcatttaggtgacactatagtttgcgtgctcaggaatagagtttcagagctatgctggaaacagc

SEQ ID NO: 60265 - DNA, 70 bp, Artificial Sequence
  Synthetic
gccaagcatttaggtgacactatagtttgttgttcatctcttctcgtttcagagctatgctggaaacagc

SEQ ID NO: 60266 - DNA, 70 bp, Artificial Sequence
  Synthetic
gccaagcatttaggtgacactatagctcggtggcactcagctatagtttcagagctatgctggaaacagc

SEQ ID NO: 60267 - DNA, 70 bp, Artificial Sequence
  Synthetic
gccaagcatttaggtgacactatagggcttcatcctgactgtcaggtttcagagctatgctggaaacagc

SEQ ID NO: 60268 - DNA, 70 bp, Artificial Sequence
  Synthetic
gccaagcatttaggtgacactatagcatagcaagcagctcaaacagtttcagagctatgctggaaacagc

SEQ ID NO: 60269 - DNA, 70 bp, Artificial Sequence
  Synthetic
gccaagcatttaggtgacactataggggagtctagagcgtgaccggtttcagagctatgctggaaacagc

SEQ ID NO: 60270 - DNA, 70 bp, Artificial Sequence
  Synthetic
gccaagcatttaggtgacactataggggcaaaggacagggacctggtttcagagctatgctggaaacagc

SEQ ID NO: 60271 - DNA, 70 bp, Artificial Sequence
  Synthetic
gccaagcatttaggtgacactatagggaggtggcggctcaagtgagtttcagagctatgctggaaacagc

SEQ ID NO: 60272 - DNA, 70 bp, Artificial Sequence
  Synthetic
gccaagcatttaggtgacactatagaatggccccaaaaaaggagggtttcagagctatgctggaaacagc

SEQ ID NO: 60273 - DNA, 70 bp, Artificial Sequence
  Synthetic
gccaagcatttaggtgacactatagggaagatatggaccatcactgtttcagagctatgctggaaacagc

SEQ ID NO: 60274 - DNA, 70 bp, Artificial Sequence
  Synthetic
gccaagcatttaggtgacactatagtgttaggagtcatcgtacaggtttcagagctatgctggaaacagc

SEQ ID NO: 60275 - DNA, 70 bp, Artificial Sequence
  Synthetic
gccaagcatttaggtgacactatagtctttgaagttcctgacacagtttcagagctatgctggaaacagc

SEQ ID NO: 60276 - DNA, 70 bp, Artificial Sequence
  Synthetic
gccaagcatttaggtgacactatagaagacctccctgtggtaattgtttcagagctatgctggaaacagc

SEQ ID NO: 60277 - DNA, 70 bp, Artificial Sequence
  Synthetic
gccaagcatttaggtgacactatagggccccttcggttaagtgtcgtttcagagctatgctggaaacagc

SEQ ID NO: 60278 - DNA, 70 bp, Artificial Sequence
  Synthetic
gccaagcatttaggtgacactatagtgaaagtctatcaagtactcgtttcagagctatgctggaaacagc

SEQ ID NO: 60279 - DNA, 70 bp, Artificial Sequence
  Synthetic
gccaagcatttaggtgacactatagcactcctgtgcgctcactgtgtttcagagctatgctggaaacagc

SEQ ID NO: 60280 - DNA, 70 bp, Artificial Sequence
  Synthetic
gccaagcatttaggtgacactatagtaaggtactctgggtatgctgtttcagagctatgctggaaacagc

SEQ ID NO: 60281 - DNA, 70 bp, Artificial Sequence
  Synthetic
gccaagcatttaggtgacactatagacgatctccaaagctatttggtttcagagctatgctggaaacagc

SEQ ID NO: 60282 - DNA, 70 bp, Artificial Sequence
  Synthetic
gccaagcatttaggtgacactatagcctctgctttccaacactttgtttcagagctatgctggaaacagc

SEQ ID NO: 60283 - DNA, 70 bp, Artificial Sequence
  Synthetic
gccaagcatttaggtgacactatagagtttaatttccttcagctggtttcagagctatgctggaaacagc

SEQ ID NO: 60284 - DNA, 70 bp, Artificial Sequence
  Synthetic
gccaagcatttaggtgacactataggggacagggcgggcactcaggtttcagagctatgctggaaacagc

SEQ ID NO: 60285 - DNA, 70 bp, Artificial Sequence
  Synthetic
gccaagcatttaggtgacactatagagagtcctccattacagtcagtttcagagctatgctggaaacagc

SEQ ID NO: 60286 - DNA, 70 bp, Artificial Sequence
  Synthetic
gccaagcatttaggtgacactatagcaggtttacacaaactgagggtttcagagctatgctggaaacagc

SEQ ID NO: 60287 - DNA, 70 bp, Artificial Sequence
  Synthetic
gccaagcatttaggtgacactatagatcaaactgctactggttaagtttcagagctatgctggaaacagc

SEQ ID NO: 60288 - DNA, 70 bp, Artificial Sequence
  Synthetic
gccaagcatttaggtgacactatagccttggaggggattcgcaaggtttcagagctatgctggaaacagc

SEQ ID NO: 60289 - DNA, 70 bp, Artificial Sequence
  Synthetic
gccaagcatttaggtgacactatagtggggctactctgtggaattgtttcagagctatgctggaaacagc

SEQ ID NO: 60290 - DNA, 70 bp, Artificial Sequence
  Synthetic
gccaagcatttaggtgacactatagaaaactgagttaactttgccgtttcagagctatgctggaaacagc

SEQ ID NO: 60291 - DNA, 70 bp, Artificial Sequence
  Synthetic
gccaagcatttaggtgacactatagaattaagactccttgcacaggtttcagagctatgctggaaacagc

SEQ ID NO: 60292 - DNA, 70 bp, Artificial Sequence
  Synthetic
gccaagcatttaggtgacactatagctgaccattatgaggacgttgtttcagagctatgctggaaacagc

SEQ ID NO: 60293 - DNA, 70 bp, Artificial Sequence
  Synthetic
gccaagcatttaggtgacactatagggcatttagacagtctgcacgtttcagagctatgctggaaacagc

SEQ ID NO: 60294 - DNA, 70 bp, Artificial Sequence
  Synthetic
gccaagcatttaggtgacactataggtaccgtaacgtggagtgaggtttcagagctatgctggaaacagc

SEQ ID NO: 60295 - DNA, 70 bp, Artificial Sequence
  Synthetic
gccaagcatttaggtgacactatagtacaagaacgtggagtgacggtttcagagctatgctggaaacagc

SEQ ID NO: 60296 - DNA, 70 bp, Artificial Sequence
  Synthetic
gccaagcatttaggtgacactatagggaggcagtgagggtcaattgtttcagagctatgctggaaacagc

SEQ ID NO: 60297 - DNA, 70 bp, Artificial Sequence
  Synthetic
gccaagcatttaggtgacactatagtcatgaaagtactgttagcagtttcagagctatgctggaaacagc

SEQ ID NO: 60298 - DNA, 70 bp, Artificial Sequence
  Synthetic
gccaagcatttaggtgacactatagactcggttctctctctgagcgtttcagagctatgctggaaacagc

SEQ ID NO: 60299 - DNA, 70 bp, Artificial Sequence
  Synthetic
gccaagcatttaggtgacactatagggaagaaattggtgtttagcgtttcagagctatgctggaaacagc

SEQ ID NO: 60300 - DNA, 70 bp, Artificial Sequence
  Synthetic
gccaagcatttaggtgacactatagtctaaaggtcttcattgcacgtttcagagctatgctggaaacagc

SEQ ID NO: 60301 - DNA, 70 bp, Artificial Sequence
  Synthetic
gccaagcatttaggtgacactatagacgtagaactaaactccctcgtttcagagctatgctggaaacagc

SEQ ID NO: 60302 - DNA, 70 bp, Artificial Sequence
  Synthetic
gccaagcatttaggtgacactatagtgacatttgatctcaggaatgtttcagagctatgctggaaacagc

SEQ ID NO: 60303 - DNA, 70 bp, Artificial Sequence
  Synthetic
gccaagcatttaggtgacactatagagcacagtgtcactctcaacgtttcagagctatgctggaaacagc

SEQ ID NO: 60304 - DNA, 70 bp, Artificial Sequence
  Synthetic
gccaagcatttaggtgacactatagggctcatgacagcacagttagtttcagagctatgctggaaacagc

SEQ ID NO: 60305 - DNA, 70 bp, Artificial Sequence
  Synthetic
gccaagcatttaggtgacactatagtctgatcccctcgttttaatgtttcagagctatgctggaaacagc

SEQ ID NO: 60306 - DNA, 70 bp, Artificial Sequence
  Synthetic
gccaagcatttaggtgacactatagccggcagaaactgaacttgcgtttcagagctatgctggaaacagc

SEQ ID NO: 60307 - DNA, 70 bp, Artificial Sequence
  Synthetic
gccaagcatttaggtgacactatagacaaacagatcagtaaatccgtttcagagctatgctggaaacagc

SEQ ID NO: 60308 - DNA, 70 bp, Artificial Sequence
  Synthetic
gccaagcatttaggtgacactatagatggggcctgaagggaaatggtttcagagctatgctggaaacagc

SEQ ID NO: 60309 - DNA, 70 bp, Artificial Sequence
  Synthetic
gccaagcatttaggtgacactatagtaggagtcagagctctcaatgtttcagagctatgctggaaacagc

SEQ ID NO: 60310 - DNA, 70 bp, Artificial Sequence
  Synthetic
gccaagcatttaggtgacactatagcagtggcctgttggctagccgtttcagagctatgctggaaacagc

SEQ ID NO: 60311 - DNA, 70 bp, Artificial Sequence
  Synthetic
gccaagcatttaggtgacactatagtgagtcttgaatcctctaccgtttcagagctatgctggaaacagc

SEQ ID NO: 60312 - DNA, 70 bp, Artificial Sequence
  Synthetic
gccaagcatttaggtgacactatagcggggagagctgcccctagggtttcagagctatgctggaaacagc

SEQ ID NO: 60313 - DNA, 70 bp, Artificial Sequence
  Synthetic
gccaagcatttaggtgacactatagttttaggcttctctgaacttgtttcagagctatgctggaaacagc

SEQ ID NO: 60314 - DNA, 70 bp, Artificial Sequence
  Synthetic
gccaagcatttaggtgacactatagacacggcctacaacgaggctgtttcagagctatgctggaaacagc

SEQ ID NO: 60315 - DNA, 70 bp, Artificial Sequence
  Synthetic
gccaagcatttaggtgacactatagccctccggggtggggtcagagtttcagagctatgctggaaacagc

SEQ ID NO: 60316 - DNA, 70 bp, Artificial Sequence
  Synthetic
gccaagcatttaggtgacactataggtggtccccgcggtaactaggtttcagagctatgctggaaacagc

SEQ ID NO: 60317 - DNA, 70 bp, Artificial Sequence
  Synthetic
gccaagcatttaggtgacactatagcagtggagaagaggaagaccgtttcagagctatgctggaaacagc

SEQ ID NO: 60318 - DNA, 70 bp, Artificial Sequence
  Synthetic
gccaagcatttaggtgacactatagcagttcacttacgcgatatcgtttcagagctatgctggaaacagc

SEQ ID NO: 60319 - DNA, 70 bp, Artificial Sequence
  Synthetic
gccaagcatttaggtgacactatagccggagtttcctcgcattaagtttcagagctatgctggaaacagc

SEQ ID NO: 60320 - DNA, 70 bp, Artificial Sequence
  Synthetic
gccaagcatttaggtgacactatagctgggtgacttggagggcatgtttcagagctatgctggaaacagc

SEQ ID NO: 60321 - DNA, 70 bp, Artificial Sequence
  Synthetic
gccaagcatttaggtgacactatagtaagccttggactttttagggtttcagagctatgctggaaacagc

SEQ ID NO: 60322 - DNA, 70 bp, Artificial Sequence
  Synthetic
gccaagcatttaggtgacactatagttttgtcgaacgtgttcaaagtttcagagctatgctggaaacagc

SEQ ID NO: 60323 - DNA, 70 bp, Artificial Sequence
  Synthetic
gccaagcatttaggtgacactatagctactgtatggcttggaatggtttcagagctatgctggaaacagc

SEQ ID NO: 60324 - DNA, 70 bp, Artificial Sequence
  Synthetic
gccaagcatttaggtgacactatagaggcgggcaccaaacactgagtttcagagctatgctggaaacagc

SEQ ID NO: 60325 - DNA, 70 bp, Artificial Sequence
  Synthetic
gccaagcatttaggtgacactatagctggctccaagggtcagtgagtttcagagctatgctggaaacagc

SEQ ID NO: 60326 - DNA, 70 bp, Artificial Sequence
  Synthetic
gccaagcatttaggtgacactatagaacctgatatgtctcaatacgtttcagagctatgctggaaacagc

SEQ ID NO: 60327 - DNA, 70 bp, Artificial Sequence
  Synthetic
gccaagcatttaggtgacactatagattggcttgaccagtcaagtgtttcagagctatgctggaaacagc

SEQ ID NO: 60328 - DNA, 70 bp, Artificial Sequence
  Synthetic
gccaagcatttaggtgacactataggtcgccccaggggccctagtgtttcagagctatgctggaaacagc

SEQ ID NO: 60329 - DNA, 70 bp, Artificial Sequence
  Synthetic
gccaagcatttaggtgacactatagtttaggtgaactgttccatcgtttcagagctatgctggaaacagc

SEQ ID NO: 60330 - DNA, 70 bp, Artificial Sequence
  Synthetic
gccaagcatttaggtgacactataggctggagttggggaagcgccgtttcagagctatgctggaaacagc

SEQ ID NO: 60331 - DNA, 70 bp, Artificial Sequence
  Synthetic
gccaagcatttaggtgacactataggtccccatggcaactacagagtttcagagctatgctggaaacagc

SEQ ID NO: 60332 - DNA, 70 bp, Artificial Sequence
  Synthetic
gccaagcatttaggtgacactatagcacggcttccgcgctctgatgtttcagagctatgctggaaacagc

SEQ ID NO: 60333 - DNA, 70 bp, Artificial Sequence
  Synthetic
gccaagcatttaggtgacactatagccttgcaagtgttcgagcttgtttcagagctatgctggaaacagc

SEQ ID NO: 60334 - DNA, 70 bp, Artificial Sequence
  Synthetic
gccaagcatttaggtgacactataggctcaagagaagacaacacagtttcagagctatgctggaaacagc

SEQ ID NO: 60335 - DNA, 70 bp, Artificial Sequence
  Synthetic
gccaagcatttaggtgacactatagtggagtgctcactcaaacgcgtttcagagctatgctggaaacagc

SEQ ID NO: 60336 - DNA, 70 bp, Artificial Sequence
  Synthetic
gccaagcatttaggtgacactataggaggggagaggcagtctttggtttcagagctatgctggaaacagc

SEQ ID NO: 60337 - DNA, 70 bp, Artificial Sequence
  Synthetic
gccaagcatttaggtgacactatagtggacttcgatgagacctgagtttcagagctatgctggaaacagc

SEQ ID NO: 60338 - DNA, 70 bp, Artificial Sequence
  Synthetic
gccaagcatttaggtgacactataggctacttgcacagaccccttgtttcagagctatgctggaaacagc

SEQ ID NO: 60339 - DNA, 70 bp, Artificial Sequence
  Synthetic
gccaagcatttaggtgacactatagagtggtgaaaaagctatgtagtttcagagctatgctggaaacagc

SEQ ID NO: 60340 - DNA, 70 bp, Artificial Sequence
  Synthetic
gccaagcatttaggtgacactatagtgcacacattgttgaagctcgtttcagagctatgctggaaacagc

SEQ ID NO: 60341 - DNA, 70 bp, Artificial Sequence
  Synthetic
gccaagcatttaggtgacactatagagggcacactgacagcctaggtttcagagctatgctggaaacagc

SEQ ID NO: 60342 - DNA, 70 bp, Artificial Sequence
  Synthetic
gccaagcatttaggtgacactatagaggggatagtacatatgagagtttcagagctatgctggaaacagc

SEQ ID NO: 60343 - DNA, 70 bp, Artificial Sequence
  Synthetic
gccaagcatttaggtgacactataggaagacagcattccagacctgtttcagagctatgctggaaacagc

SEQ ID NO: 60344 - DNA, 70 bp, Artificial Sequence
  Synthetic
gccaagcatttaggtgacactatagtgtatgcttggcgaatgttggtttcagagctatgctggaaacagc

SEQ ID NO: 60345 - DNA, 70 bp, Artificial Sequence
  Synthetic
gccaagcatttaggtgacactatagagatctcacggatgccacgtgtttcagagctatgctggaaacagc

SEQ ID NO: 60346 - DNA, 70 bp, Artificial Sequence
  Synthetic
gccaagcatttaggtgacactatagcagacaggaggatacagtgagtttcagagctatgctggaaacagc

SEQ ID NO: 60347 - DNA, 70 bp, Artificial Sequence
  Synthetic
gccaagcatttaggtgacactataggcgattgctgggagatcagtgtttcagagctatgctggaaacagc

SEQ ID NO: 60348 - DNA, 70 bp, Artificial Sequence
  Synthetic
gccaagcatttaggtgacactatagccctgaggggcaagatcagtgtttcagagctatgctggaaacagc

SEQ ID NO: 60349 - DNA, 70 bp, Artificial Sequence
  Synthetic
gccaagcatttaggtgacactatagcagacgggaggctacagtgagtttcagagctatgctggaaacagc

SEQ ID NO: 60350 - DNA, 70 bp, Artificial Sequence
  Synthetic
gccaagcatttaggtgacactatagtgtggccagagattagttaggtttcagagctatgctggaaacagc

SEQ ID NO: 60351 - DNA, 70 bp, Artificial Sequence
  Synthetic
gccaagcatttaggtgacactataggtactggagttgatgctgccgtttcagagctatgctggaaacagc

SEQ ID NO: 60352 - DNA, 70 bp, Artificial Sequence
  Synthetic
gccaagcatttaggtgacactataggtggggcagggtgtcagcccgtttcagagctatgctggaaacagc

SEQ ID NO: 60353 - DNA, 70 bp, Artificial Sequence
  Synthetic
gccaagcatttaggtgacactatagggcaagatcactcgatctccgtttcagagctatgctggaaacagc

SEQ ID NO: 60354 - DNA, 70 bp, Artificial Sequence
  Synthetic
gccaagcatttaggtgacactataggaagggcagggtctatgtcagtttcagagctatgctggaaacagc

SEQ ID NO: 60355 - DNA, 70 bp, Artificial Sequence
  Synthetic
gccaagcatttaggtgacactataggcttgccaactacagatcttgtttcagagctatgctggaaacagc

SEQ ID NO: 60356 - DNA, 70 bp, Artificial Sequence
  Synthetic
gccaagcatttaggtgacactataggaccaaaaaagatgtgaagcgtttcagagctatgctggaaacagc

SEQ ID NO: 60357 - DNA, 70 bp, Artificial Sequence
  Synthetic
gccaagcatttaggtgacactatagtttcctctgagaagggcatggtttcagagctatgctggaaacagc

SEQ ID NO: 60358 - DNA, 70 bp, Artificial Sequence
  Synthetic
gccaagcatttaggtgacactatagcctcggagacgggtggcatggtttcagagctatgctggaaacagc

SEQ ID NO: 60359 - DNA, 70 bp, Artificial Sequence
  Synthetic
gccaagcatttaggtgacactatagggattacagcgtgcccatccgtttcagagctatgctggaaacagc

SEQ ID NO: 60360 - DNA, 70 bp, Artificial Sequence
  Synthetic
gccaagcatttaggtgacactataggtacctcagctggcctcagtgtttcagagctatgctggaaacagc

SEQ ID NO: 60361 - DNA, 70 bp, Artificial Sequence
  Synthetic
gccaagcatttaggtgacactatagtcaatccagaagctttctccgtttcagagctatgctggaaacagc

SEQ ID NO: 60362 - DNA, 70 bp, Artificial Sequence
  Synthetic
gccaagcatttaggtgacactatagtgctcgtggagctggaatgagtttcagagctatgctggaaacagc

SEQ ID NO: 60363 - DNA, 70 bp, Artificial Sequence
  Synthetic
gccaagcatttaggtgacactataggcaagaaggtacaacgtcctgtttcagagctatgctggaaacagc

SEQ ID NO: 60364 - DNA, 70 bp, Artificial Sequence
  Synthetic
gccaagcatttaggtgacactatagggaccgaggtgtgggagtgagtttcagagctatgctggaaacagc

SEQ ID NO: 60365 - DNA, 70 bp, Artificial Sequence
  Synthetic
gccaagcatttaggtgacactatagccggccagtagggggctcacgtttcagagctatgctggaaacagc

SEQ ID NO: 60366 - DNA, 70 bp, Artificial Sequence
  Synthetic
gccaagcatttaggtgacactatagctggagaggaaggagctggagtttcagagctatgctggaaacagc

SEQ ID NO: 60367 - DNA, 70 bp, Artificial Sequence
  Synthetic
gccaagcatttaggtgacactatagtcagaaagcctcctctagccgtttcagagctatgctggaaacagc

SEQ ID NO: 60368 - DNA, 70 bp, Artificial Sequence
  Synthetic
gccaagcatttaggtgacactatagcaagggatgttcttccataagtttcagagctatgctggaaacagc

SEQ ID NO: 60369 - DNA, 70 bp, Artificial Sequence
  Synthetic
gccaagcatttaggtgacactatagggtcatggcagaaggggaaggtttcagagctatgctggaaacagc

SEQ ID NO: 60370 - DNA, 70 bp, Artificial Sequence
  Synthetic
gccaagcatttaggtgacactatagcaagggatgtgtttccataagtttcagagctatgctggaaacagc

SEQ ID NO: 60371 - DNA, 70 bp, Artificial Sequence
  Synthetic
gccaagcatttaggtgacactatagggtctggtgtgtacggacacgtttcagagctatgctggaaacagc

SEQ ID NO: 60372 - DNA, 70 bp, Artificial Sequence
  Synthetic
gccaagcatttaggtgacactatagggcgtctgaggtatgttcacgtttcagagctatgctggaaacagc

SEQ ID NO: 60373 - DNA, 70 bp, Artificial Sequence
  Synthetic
gccaagcatttaggtgacactatagaattagagagcctagtgagggtttcagagctatgctggaaacagc

SEQ ID NO: 60374 - DNA, 70 bp, Artificial Sequence
  Synthetic
gccaagcatttaggtgacactatagattggtcacagttttgtcatgtttcagagctatgctggaaacagc

SEQ ID NO: 60375 - DNA, 70 bp, Artificial Sequence
  Synthetic
gccaagcatttaggtgacactatagtcacatctgaacaaaacaaggtttcagagctatgctggaaacagc

SEQ ID NO: 60376 - DNA, 70 bp, Artificial Sequence
  Synthetic
gccaagcatttaggtgacactatagtcgccaggagcaaactctgagtttcagagctatgctggaaacagc

SEQ ID NO: 60377 - DNA, 70 bp, Artificial Sequence
  Synthetic
gccaagcatttaggtgacactatagtttcactttctcacagccacgtttcagagctatgctggaaacagc

SEQ ID NO: 60378 - DNA, 70 bp, Artificial Sequence
  Synthetic
gccaagcatttaggtgacactatagtcgctaaaatctcctagctcgtttcagagctatgctggaaacagc

SEQ ID NO: 60379 - DNA, 70 bp, Artificial Sequence
  Synthetic
gccaagcatttaggtgacactatagccctggtgtgaagcgtctgagtttcagagctatgctggaaacagc

SEQ ID NO: 60380 - DNA, 70 bp, Artificial Sequence
  Synthetic
gccaagcatttaggtgacactatagtatgcgagagagaaagccaagtttcagagctatgctggaaacagc

SEQ ID NO: 60381 - DNA, 70 bp, Artificial Sequence
  Synthetic
gccaagcatttaggtgacactatagcagccaaacacagtaatgtagtttcagagctatgctggaaacagc

SEQ ID NO: 60382 - DNA, 70 bp, Artificial Sequence
  Synthetic
gccaagcatttaggtgacactataggttgctcctttatagcctacgtttcagagctatgctggaaacagc

SEQ ID NO: 60383 - DNA, 70 bp, Artificial Sequence
  Synthetic
gccaagcatttaggtgacactatagtcagagttattagccctcccgtttcagagctatgctggaaacagc

SEQ ID NO: 60384 - DNA, 70 bp, Artificial Sequence
  Synthetic
gccaagcatttaggtgacactatagttttcattggctcccttcttgtttcagagctatgctggaaacagc

SEQ ID NO: 60385 - DNA, 70 bp, Artificial Sequence
  Synthetic
gccaagcatttaggtgacactatagacatactggcacgttaatacgtttcagagctatgctggaaacagc

SEQ ID NO: 60386 - DNA, 70 bp, Artificial Sequence
  Synthetic
gccaagcatttaggtgacactatagtcttagagttggtgctccttgtttcagagctatgctggaaacagc

SEQ ID NO: 60387 - DNA, 70 bp, Artificial Sequence
  Synthetic
gccaagcatttaggtgacactatagtaagtccaactttcgagtttgtttcagagctatgctggaaacagc

SEQ ID NO: 60388 - DNA, 70 bp, Artificial Sequence
  Synthetic
gccaagcatttaggtgacactatagggggaccactctaggaaggtgtttcagagctatgctggaaacagc

SEQ ID NO: 60389 - DNA, 70 bp, Artificial Sequence
  Synthetic
gccaagcatttaggtgacactatagtttcacatacacttcctgatgtttcagagctatgctggaaacagc

SEQ ID NO: 60390 - DNA, 70 bp, Artificial Sequence
  Synthetic
gccaagcatttaggtgacactatagtaataacttacttcactggggtttcagagctatgctggaaacagc

SEQ ID NO: 60391 - DNA, 70 bp, Artificial Sequence
  Synthetic
gccaagcatttaggtgacactatagggactcagaatgcttgaaaggtttcagagctatgctggaaacagc

SEQ ID NO: 60392 - DNA, 70 bp, Artificial Sequence
  Synthetic
gccaagcatttaggtgacactatagaatagtttcaagaggcaagcgtttcagagctatgctggaaacagc

SEQ ID NO: 60393 - DNA, 70 bp, Artificial Sequence
  Synthetic
gccaagcatttaggtgacactatagagaatcagaatacgtaggaagtttcagagctatgctggaaacagc

SEQ ID NO: 60394 - DNA, 70 bp, Artificial Sequence
  Synthetic
gccaagcatttaggtgacactatagcctcaatgtttccactcctcgtttcagagctatgctggaaacagc

SEQ ID NO: 60395 - DNA, 70 bp, Artificial Sequence
  Synthetic
gccaagcatttaggtgacactatagaactgaggaatcctttgcaagtttcagagctatgctggaaacagc

SEQ ID NO: 60396 - DNA, 70 bp, Artificial Sequence
  Synthetic
gccaagcatttaggtgacactatagtgaaaattgggagggaaagagtttcagagctatgctggaaacagc

SEQ ID NO: 60397 - DNA, 70 bp, Artificial Sequence
  Synthetic
gccaagcatttaggtgacactataggatgggtaaggcggagaatcgtttcagagctatgctggaaacagc

SEQ ID NO: 60398 - DNA, 70 bp, Artificial Sequence
  Synthetic
gccaagcatttaggtgacactatagatgactcacattgtctgtaggtttcagagctatgctggaaacagc

SEQ ID NO: 60399 - DNA, 70 bp, Artificial Sequence
  Synthetic
gccaagcatttaggtgacactataggatctgggatcagttgatgtgtttcagagctatgctggaaacagc

SEQ ID NO: 60400 - DNA, 70 bp, Artificial Sequence
  Synthetic
gccaagcatttaggtgacactatagaaaactatttgaacggccccgtttcagagctatgctggaaacagc

SEQ ID NO: 60401 - DNA, 70 bp, Artificial Sequence
  Synthetic
gccaagcatttaggtgacactatagtcacgctaatgtcaatgccagtttcagagctatgctggaaacagc

SEQ ID NO: 60402 - DNA, 70 bp, Artificial Sequence
  Synthetic
gccaagcatttaggtgacactatagtttccatttgaggacctcacgtttcagagctatgctggaaacagc

SEQ ID NO: 60403 - DNA, 70 bp, Artificial Sequence
  Synthetic
gccaagcatttaggtgacactatagtcccccaatatcctgtgattgtttcagagctatgctggaaacagc

SEQ ID NO: 60404 - DNA, 70 bp, Artificial Sequence
  Synthetic
gccaagcatttaggtgacactatagacatatagtcatcagataccgtttcagagctatgctggaaacagc

SEQ ID NO: 60405 - DNA, 70 bp, Artificial Sequence
  Synthetic
gccaagcatttaggtgacactatagtccaccttccgaaatagcttgtttcagagctatgctggaaacagc

SEQ ID NO: 60406 - DNA, 70 bp, Artificial Sequence
  Synthetic
gccaagcatttaggtgacactatagtccacctttcgaaatagcttgtttcagagctatgctggaaacagc

SEQ ID NO: 60407 - DNA, 70 bp, Artificial Sequence
  Synthetic
gccaagcatttaggtgacactatagtcccccatttcagaataattgtttcagagctatgctggaaacagc

SEQ ID NO: 60408 - DNA, 70 bp, Artificial Sequence
  Synthetic
gccaagcatttaggtgacactatagctaccttccccaataactttgtttcagagctatgctggaaacagc

SEQ ID NO: 60409 - DNA, 70 bp, Artificial Sequence
  Synthetic
gccaagcatttaggtgacactatagtgacactggtaggaatatgggtttcagagctatgctggaaacagc

SEQ ID NO: 60410 - DNA, 70 bp, Artificial Sequence
  Synthetic
gccaagcatttaggtgacactatagttgtaagccaggactctagggtttcagagctatgctggaaacagc

SEQ ID NO: 60411 - DNA, 70 bp, Artificial Sequence
  Synthetic
gccaagcatttaggtgacactatagatccccaacttctctccttagtttcagagctatgctggaaacagc

SEQ ID NO: 60412 - DNA, 70 bp, Artificial Sequence
  Synthetic
gccaagcatttaggtgacactatagttcaaagctcttcctgaaacgtttcagagctatgctggaaacagc

SEQ ID NO: 60413 - DNA, 70 bp, Artificial Sequence
  Synthetic
gccaagcatttaggtgacactatagccccaagttcagaaatagctgtttcagagctatgctggaaacagc

SEQ ID NO: 60414 - DNA, 70 bp, Artificial Sequence
  Synthetic
gccaagcatttaggtgacactataggctgccttccggaatagcttgtttcagagctatgctggaaacagc

SEQ ID NO: 60415 - DNA, 70 bp, Artificial Sequence
  Synthetic
gccaagcatttaggtgacactatagtaatcccacacttaactgaagtttcagagctatgctggaaacagc

SEQ ID NO: 60416 - DNA, 70 bp, Artificial Sequence
  Synthetic
gccaagcatttaggtgacactatagtcgcccatttcagaataattgtttcagagctatgctggaaacagc

SEQ ID NO: 60417 - DNA, 70 bp, Artificial Sequence
  Synthetic
gccaagcatttaggtgacactatagtctaactttaggaatggcttgtttcagagctatgctggaaacagc

SEQ ID NO: 60418 - DNA, 70 bp, Artificial Sequence
  Synthetic
gccaagcatttaggtgacactatagtctactctccccaatagcttgtttcagagctatgctggaaacagc

SEQ ID NO: 60419 - DNA, 70 bp, Artificial Sequence
  Synthetic
gccaagcatttaggtgacactatagttgtcttcaagtaaagactggtttcagagctatgctggaaacagc

SEQ ID NO: 60420 - DNA, 70 bp, Artificial Sequence
  Synthetic
gccaagcatttaggtgacactatagtgaagtttgcggcatgatgggtttcagagctatgctggaaacagc

SEQ ID NO: 60421 - DNA, 70 bp, Artificial Sequence
  Synthetic
gccaagcatttaggtgacactatagccccaaacagttttcataacgtttcagagctatgctggaaacagc

SEQ ID NO: 60422 - DNA, 70 bp, Artificial Sequence
  Synthetic
gccaagcatttaggtgacactatagagacagtcatgggttaattggtttcagagctatgctggaaacagc

SEQ ID NO: 60423 - DNA, 70 bp, Artificial Sequence
  Synthetic
gccaagcatttaggtgacactatagaagagaagaaacgttttctcgtttcagagctatgctggaaacagc

SEQ ID NO: 60424 - DNA, 70 bp, Artificial Sequence
  Synthetic
gccaagcatttaggtgacactatagaagaaggagaagaagtaacagtttcagagctatgctggaaacagc

SEQ ID NO: 60425 - DNA, 70 bp, Artificial Sequence
  Synthetic
gccaagcatttaggtgacactatagaggagattccaacctacttcgtttcagagctatgctggaaacagc

SEQ ID NO: 60426 - DNA, 70 bp, Artificial Sequence
  Synthetic
gccaagcatttaggtgacactatagaaaaggagaccctaatcttcgtttcagagctatgctggaaacagc

SEQ ID NO: 60427 - DNA, 70 bp, Artificial Sequence
  Synthetic
gccaagcatttaggtgacactatagcaaagaagaacggcgagttcgtttcagagctatgctggaaacagc

SEQ ID NO: 60428 - DNA, 70 bp, Artificial Sequence
  Synthetic
gccaagcatttaggtgacactataggagtttctttccgcctaagcgtttcagagctatgctggaaacagc

SEQ ID NO: 60429 - DNA, 70 bp, Artificial Sequence
  Synthetic
gccaagcatttaggtgacactataggcccttcctttatttccatggtttcagagctatgctggaaacagc

SEQ ID NO: 60430 - DNA, 70 bp, Artificial Sequence
  Synthetic
gccaagcatttaggtgacactataggaatgaagctgatcatggtcgtttcagagctatgctggaaacagc

SEQ ID NO: 60431 - DNA, 70 bp, Artificial Sequence
  Synthetic
gccaagcatttaggtgacactatagagaagacacccctttggttcgtttcagagctatgctggaaacagc

SEQ ID NO: 60432 - DNA, 70 bp, Artificial Sequence
  Synthetic
gccaagcatttaggtgacactatagctcacgtgcgaagacaaagagtttcagagctatgctggaaacagc

SEQ ID NO: 60433 - DNA, 70 bp, Artificial Sequence
  Synthetic
gccaagcatttaggtgacactatagtgcctcagatactattttgagtttcagagctatgctggaaacagc

SEQ ID NO: 60434 - DNA, 70 bp, Artificial Sequence
  Synthetic
gccaagcatttaggtgacactatagccagaaatgccttctaattcgtttcagagctatgctggaaacagc

SEQ ID NO: 60435 - DNA, 70 bp, Artificial Sequence
  Synthetic
gccaagcatttaggtgacactatagcagtgaattgacttcccatcgtttcagagctatgctggaaacagc

SEQ ID NO: 60436 - DNA, 70 bp, Artificial Sequence
  Synthetic
gccaagcatttaggtgacactatagtaaatgaaactcaccaactcgtttcagagctatgctggaaacagc

SEQ ID NO: 60437 - DNA, 70 bp, Artificial Sequence
  Synthetic
gccaagcatttaggtgacactatagacatcctgagactctgacttgtttcagagctatgctggaaacagc

SEQ ID NO: 60438 - DNA, 70 bp, Artificial Sequence
  Synthetic
gccaagcatttaggtgacactatagcttcttatctgcttcaacgcgtttcagagctatgctggaaacagc

SEQ ID NO: 60439 - DNA, 70 bp, Artificial Sequence
  Synthetic
gccaagcatttaggtgacactatagaagttagtgcctttgtgagagtttcagagctatgctggaaacagc

SEQ ID NO: 60440 - DNA, 70 bp, Artificial Sequence
  Synthetic
gccaagcatttaggtgacactatagcactatgggcacttactgaggtttcagagctatgctggaaacagc

SEQ ID NO: 60441 - DNA, 70 bp, Artificial Sequence
  Synthetic
gccaagcatttaggtgacactatagccgtttgcgcgaaaccagaggtttcagagctatgctggaaacagc

SEQ ID NO: 60442 - DNA, 70 bp, Artificial Sequence
  Synthetic
gccaagcatttaggtgacactataggggacatggcctgggtagacgtttcagagctatgctggaaacagc

SEQ ID NO: 60443 - DNA, 70 bp, Artificial Sequence
  Synthetic
gccaagcatttaggtgacactatagtgagccaaggcctcaatagagtttcagagctatgctggaaacagc

SEQ ID NO: 60444 - DNA, 70 bp, Artificial Sequence
  Synthetic
gccaagcatttaggtgacactatagtacaccaccagcttgtacaggtttcagagctatgctggaaacagc

SEQ ID NO: 60445 - DNA, 70 bp, Artificial Sequence
  Synthetic
gccaagcatttaggtgacactatagtgaaagagaagaggaggtaggtttcagagctatgctggaaacagc

SEQ ID NO: 60446 - DNA, 70 bp, Artificial Sequence
  Synthetic
gccaagcatttaggtgacactatagcccgtgccccccttaacttggtttcagagctatgctggaaacagc

SEQ ID NO: 60447 - DNA, 70 bp, Artificial Sequence
  Synthetic
gccaagcatttaggtgacactatagcaagatggacttgctgtgaagtttcagagctatgctggaaacagc

SEQ ID NO: 60448 - DNA, 70 bp, Artificial Sequence
  Synthetic
gccaagcatttaggtgacactatagggtcgatactgcagtaccatgtttcagagctatgctggaaacagc

SEQ ID NO: 60449 - DNA, 70 bp, Artificial Sequence
  Synthetic
gccaagcatttaggtgacactatagtgtccttcattatggtcttggtttcagagctatgctggaaacagc

SEQ ID NO: 60450 - DNA, 70 bp, Artificial Sequence
  Synthetic
gccaagcatttaggtgacactatagaccggtccggtactgcaacagtttcagagctatgctggaaacagc

SEQ ID NO: 60451 - DNA, 70 bp, Artificial Sequence
  Synthetic
gccaagcatttaggtgacactatagagtacacggagccccgaggagtttcagagctatgctggaaacagc

SEQ ID NO: 60452 - DNA, 70 bp, Artificial Sequence
  Synthetic
gccaagcatttaggtgacactatagcgtgtactttcaacacaccggtttcagagctatgctggaaacagc

SEQ ID NO: 60453 - DNA, 70 bp, Artificial Sequence
  Synthetic
gccaagcatttaggtgacactatagtccccgcaggatatgttaaggtttcagagctatgctggaaacagc

SEQ ID NO: 60454 - DNA, 70 bp, Artificial Sequence
  Synthetic
gccaagcatttaggtgacactatagagaataagccagatgtaatcgtttcagagctatgctggaaacagc

SEQ ID NO: 60455 - DNA, 70 bp, Artificial Sequence
  Synthetic
gccaagcatttaggtgacactatagacaacctccaaccatcttctgtttcagagctatgctggaaacagc

SEQ ID NO: 60456 - DNA, 70 bp, Artificial Sequence
  Synthetic
gccaagcatttaggtgacactatagttttgtgcacacgtctctccgtttcagagctatgctggaaacagc

SEQ ID NO: 60457 - DNA, 70 bp, Artificial Sequence
  Synthetic
gccaagcatttaggtgacactatagtttgtgtgatcaggttgcaagtttcagagctatgctggaaacagc

SEQ ID NO: 60458 - DNA, 70 bp, Artificial Sequence
  Synthetic
gccaagcatttaggtgacactatagttgaatgcggagttgttgcagtttcagagctatgctggaaacagc

SEQ ID NO: 60459 - DNA, 70 bp, Artificial Sequence
  Synthetic
gccaagcatttaggtgacactatagtttcttcaatgcgtttgagtgtttcagagctatgctggaaacagc

SEQ ID NO: 60460 - DNA, 70 bp, Artificial Sequence
  Synthetic
gccaagcatttaggtgacactataggtagtagcaaggctctcactgtttcagagctatgctggaaacagc

SEQ ID NO: 60461 - DNA, 70 bp, Artificial Sequence
  Synthetic
gccaagcatttaggtgacactatagggagtttttcagatggattggtttcagagctatgctggaaacagc

SEQ ID NO: 60462 - DNA, 70 bp, Artificial Sequence
  Synthetic
gccaagcatttaggtgacactatagtgaagacatctcatatactcgtttcagagctatgctggaaacagc

SEQ ID NO: 60463 - DNA, 70 bp, Artificial Sequence
  Synthetic
gccaagcatttaggtgacactatagataaagaaaagcagtggtccgtttcagagctatgctggaaacagc

SEQ ID NO: 60464 - DNA, 70 bp, Artificial Sequence
  Synthetic
gccaagcatttaggtgacactatagaagataaaatcacttccaccgtttcagagctatgctggaaacagc

SEQ ID NO: 60465 - DNA, 70 bp, Artificial Sequence
  Synthetic
gccaagcatttaggtgacactatagaagcttttaaagattcaggggtttcagagctatgctggaaacagc

SEQ ID NO: 60466 - DNA, 70 bp, Artificial Sequence
  Synthetic
gccaagcatttaggtgacactatagaagtagtatttcaggggatcgtttcagagctatgctggaaacagc

SEQ ID NO: 60467 - DNA, 70 bp, Artificial Sequence
  Synthetic
gccaagcatttaggtgacactatagcgaggatgaagaaggatcttgtttcagagctatgctggaaacagc

SEQ ID NO: 60468 - DNA, 70 bp, Artificial Sequence
  Synthetic
gccaagcatttaggtgacactatagggaccaaactccttcaataagtttcagagctatgctggaaacagc

SEQ ID NO: 60469 - DNA, 70 bp, Artificial Sequence
  Synthetic
gccaagcatttaggtgacactatagttctgataaccagaagctgtgtttcagagctatgctggaaacagc

SEQ ID NO: 60470 - DNA, 70 bp, Artificial Sequence
  Synthetic
gccaagcatttaggtgacactatagttcactgtttaatcatcggggtttcagagctatgctggaaacagc

SEQ ID NO: 60471 - DNA, 70 bp, Artificial Sequence
  Synthetic
gccaagcatttaggtgacactatagaactggggtactagaacttggtttcagagctatgctggaaacagc

SEQ ID NO: 60472 - DNA, 70 bp, Artificial Sequence
  Synthetic
gccaagcatttaggtgacactatagtgtgtcagacgagcagtgacgtttcagagctatgctggaaacagc

SEQ ID NO: 60473 - DNA, 70 bp, Artificial Sequence
  Synthetic
gccaagcatttaggtgacactatagcaatgagtttgcatgactgagtttcagagctatgctggaaacagc

SEQ ID NO: 60474 - DNA, 70 bp, Artificial Sequence
  Synthetic
gccaagcatttaggtgacactatagggcgccaggtagctcagtacgtttcagagctatgctggaaacagc

SEQ ID NO: 60475 - DNA, 70 bp, Artificial Sequence
  Synthetic
gccaagcatttaggtgacactatagaagaataaatcggatatcccgtttcagagctatgctggaaacagc

SEQ ID NO: 60476 - DNA, 70 bp, Artificial Sequence
  Synthetic
gccaagcatttaggtgacactataggctggcctgcgtctcagtccgtttcagagctatgctggaaacagc

SEQ ID NO: 60477 - DNA, 70 bp, Artificial Sequence
  Synthetic
gccaagcatttaggtgacactataggaccaagaatcagaagctccgtttcagagctatgctggaaacagc

SEQ ID NO: 60478 - DNA, 70 bp, Artificial Sequence
  Synthetic
gccaagcatttaggtgacactataggaggagagactgggcctcaggtttcagagctatgctggaaacagc

SEQ ID NO: 60479 - DNA, 70 bp, Artificial Sequence
  Synthetic
gccaagcatttaggtgacactatagaggatgcctcaggccctcaggtttcagagctatgctggaaacagc

SEQ ID NO: 60480 - DNA, 70 bp, Artificial Sequence
  Synthetic
gccaagcatttaggtgacactatagggctgggtctcagtcctagtgtttcagagctatgctggaaacagc

SEQ ID NO: 60481 - DNA, 70 bp, Artificial Sequence
  Synthetic
gccaagcatttaggtgacactatagaaaggatcccagctcctgaagtttcagagctatgctggaaacagc

SEQ ID NO: 60482 - DNA, 70 bp, Artificial Sequence
  Synthetic
gccaagcatttaggtgacactatagtctggtggacattctgaatggtttcagagctatgctggaaacagc

SEQ ID NO: 60483 - DNA, 70 bp, Artificial Sequence
  Synthetic
gccaagcatttaggtgacactataggatccgggcagtgctcaggggtttcagagctatgctggaaacagc

SEQ ID NO: 60484 - DNA, 70 bp, Artificial Sequence
  Synthetic
gccaagcatttaggtgacactatagtgcagcgctagttcttgttagtttcagagctatgctggaaacagc

SEQ ID NO: 60485 - DNA, 70 bp, Artificial Sequence
  Synthetic
gccaagcatttaggtgacactatagtgacaacttcaggttccagcgtttcagagctatgctggaaacagc

SEQ ID NO: 60486 - DNA, 70 bp, Artificial Sequence
  Synthetic
gccaagcatttaggtgacactataggttgttgaagaaccttccgtgtttcagagctatgctggaaacagc

SEQ ID NO: 60487 - DNA, 70 bp, Artificial Sequence
  Synthetic
gccaagcatttaggtgacactatagtactcctactaccagtaaacgtttcagagctatgctggaaacagc

SEQ ID NO: 60488 - DNA, 70 bp, Artificial Sequence
  Synthetic
gccaagcatttaggtgacactatagatggaacagaatcgagagtggtttcagagctatgctggaaacagc

SEQ ID NO: 60489 - DNA, 70 bp, Artificial Sequence
  Synthetic
gccaagcatttaggtgacactatagcggaacacgtgttttagtccgtttcagagctatgctggaaacagc

SEQ ID NO: 60490 - DNA, 70 bp, Artificial Sequence
  Synthetic
gccaagcatttaggtgacactatagggcagattgaacaagagcttgtttcagagctatgctggaaacagc

SEQ ID NO: 60491 - DNA, 70 bp, Artificial Sequence
  Synthetic
gccaagcatttaggtgacactatagggcagctaggcacccttaccgtttcagagctatgctggaaacagc

SEQ ID NO: 60492 - DNA, 70 bp, Artificial Sequence
  Synthetic
gccaagcatttaggtgacactatagtggccctggaatgtgtaggagtttcagagctatgctggaaacagc

SEQ ID NO: 60493 - DNA, 70 bp, Artificial Sequence
  Synthetic
gccaagcatttaggtgacactatagagacgtaccgcacgggaagggtttcagagctatgctggaaacagc

SEQ ID NO: 60494 - DNA, 70 bp, Artificial Sequence
  Synthetic
gccaagcatttaggtgacactatagtcctgggatggggctgtcacgtttcagagctatgctggaaacagc

SEQ ID NO: 60495 - DNA, 70 bp, Artificial Sequence
  Synthetic
gccaagcatttaggtgacactataggagagacctcatcaagttttgtttcagagctatgctggaaacagc

SEQ ID NO: 60496 - DNA, 70 bp, Artificial Sequence
  Synthetic
gccaagcatttaggtgacactataggctcattaactgggccgccagtttcagagctatgctggaaacagc

SEQ ID NO: 60497 - DNA, 70 bp, Artificial Sequence
  Synthetic
gccaagcatttaggtgacactatagtttcttgaggtagttctgacgtttcagagctatgctggaaacagc

SEQ ID NO: 60498 - DNA, 70 bp, Artificial Sequence
  Synthetic
gccaagcatttaggtgacactatagacagacatgattgatcaggagtttcagagctatgctggaaacagc

SEQ ID NO: 60499 - DNA, 70 bp, Artificial Sequence
  Synthetic
gccaagcatttaggtgacactatagaggtcaagactgaactgtgagtttcagagctatgctggaaacagc

SEQ ID NO: 60500 - DNA, 70 bp, Artificial Sequence
  Synthetic
gccaagcatttaggtgacactatagtgcagcctatgatatcagtggtttcagagctatgctggaaacagc

SEQ ID NO: 60501 - DNA, 70 bp, Artificial Sequence
  Synthetic
gccaagcatttaggtgacactataggggatgaggatgaaaagtaggtttcagagctatgctggaaacagc

SEQ ID NO: 60502 - DNA, 70 bp, Artificial Sequence
  Synthetic
gccaagcatttaggtgacactataggaggtgcagagacttctagcgtttcagagctatgctggaaacagc

SEQ ID NO: 60503 - DNA, 70 bp, Artificial Sequence
  Synthetic
gccaagcatttaggtgacactatagcgcgatggtgacttctaaccgtttcagagctatgctggaaacagc

SEQ ID NO: 60504 - DNA, 70 bp, Artificial Sequence
  Synthetic
gccaagcatttaggtgacactatagcgggtcgcagttacttattcgtttcagagctatgctggaaacagc

SEQ ID NO: 60505 - DNA, 70 bp, Artificial Sequence
  Synthetic
gccaagcatttaggtgacactatagtgggttactacctgaaagaggtttcagagctatgctggaaacagc

SEQ ID NO: 60506 - DNA, 70 bp, Artificial Sequence
  Synthetic
gccaagcatttaggtgacactatagtggccaaggaagccggtcaggtttcagagctatgctggaaacagc

SEQ ID NO: 60507 - DNA, 70 bp, Artificial Sequence
  Synthetic
gccaagcatttaggtgacactatagacttcagaccttcaaaactggtttcagagctatgctggaaacagc

SEQ ID NO: 60508 - DNA, 70 bp, Artificial Sequence
  Synthetic
gccaagcatttaggtgacactataggctcagtgctagaggactaggtttcagagctatgctggaaacagc

SEQ ID NO: 60509 - DNA, 70 bp, Artificial Sequence
  Synthetic
gccaagcatttaggtgacactatagacctgtcaccacaacaaagagtttcagagctatgctggaaacagc

SEQ ID NO: 60510 - DNA, 70 bp, Artificial Sequence
  Synthetic
gccaagcatttaggtgacactatagtcagagattatagggagcatgtttcagagctatgctggaaacagc

SEQ ID NO: 60511 - DNA, 70 bp, Artificial Sequence
  Synthetic
gccaagcatttaggtgacactatagatgtaacagatacaccgtaagtttcagagctatgctggaaacagc

SEQ ID NO: 60512 - DNA, 70 bp, Artificial Sequence
  Synthetic
gccaagcatttaggtgacactatagtcaggacttcattcattaaggtttcagagctatgctggaaacagc

SEQ ID NO: 60513 - DNA, 70 bp, Artificial Sequence
  Synthetic
gccaagcatttaggtgacactatagcccaaatcatcagactcccagtttcagagctatgctggaaacagc

SEQ ID NO: 60514 - DNA, 70 bp, Artificial Sequence
  Synthetic
gccaagcatttaggtgacactatagtcttatattcagtagctctcgtttcagagctatgctggaaacagc

SEQ ID NO: 60515 - DNA, 70 bp, Artificial Sequence
  Synthetic
gccaagcatttaggtgacactatagatatggacaactaagtgagagtttcagagctatgctggaaacagc

SEQ ID NO: 60516 - DNA, 70 bp, Artificial Sequence
  Synthetic
gccaagcatttaggtgacactatagcctttaatccagtgactgtcgtttcagagctatgctggaaacagc

SEQ ID NO: 60517 - DNA, 70 bp, Artificial Sequence
  Synthetic
gccaagcatttaggtgacactatagtcatacgatactgaagaccagtttcagagctatgctggaaacagc

SEQ ID NO: 60518 - DNA, 70 bp, Artificial Sequence
  Synthetic
gccaagcatttaggtgacactatagatacaaagatactctccccagtttcagagctatgctggaaacagc

SEQ ID NO: 60519 - DNA, 70 bp, Artificial Sequence
  Synthetic
gccaagcatttaggtgacactataggagcagacatattactgctggtttcagagctatgctggaaacagc

SEQ ID NO: 60520 - DNA, 70 bp, Artificial Sequence
  Synthetic
gccaagcatttaggtgacactataggctccccagcaacgacatctgtttcagagctatgctggaaacagc

SEQ ID NO: 60521 - DNA, 70 bp, Artificial Sequence
  Synthetic
gccaagcatttaggtgacactatagtcacagtgaggatagcgaccgtttcagagctatgctggaaacagc

SEQ ID NO: 60522 - DNA, 70 bp, Artificial Sequence
  Synthetic
gccaagcatttaggtgacactatagagaaaaccccagaaaagacagtttcagagctatgctggaaacagc

SEQ ID NO: 60523 - DNA, 70 bp, Artificial Sequence
  Synthetic
gccaagcatttaggtgacactatagagcgattccgagggtgactggtttcagagctatgctggaaacagc

SEQ ID NO: 60524 - DNA, 70 bp, Artificial Sequence
  Synthetic
gccaagcatttaggtgacactatagatccccatccgtggctcagagtttcagagctatgctggaaacagc

SEQ ID NO: 60525 - DNA, 70 bp, Artificial Sequence
  Synthetic
gccaagcatttaggtgacactatagttatggtagccaaggaagacgtttcagagctatgctggaaacagc

SEQ ID NO: 60526 - DNA, 70 bp, Artificial Sequence
  Synthetic
gccaagcatttaggtgacactataggcagagatacagttgagtgtgtttcagagctatgctggaaacagc

SEQ ID NO: 60527 - DNA, 70 bp, Artificial Sequence
  Synthetic
gccaagcatttaggtgacactatagtacaagtgctatgtgatcaggtttcagagctatgctggaaacagc

SEQ ID NO: 60528 - DNA, 70 bp, Artificial Sequence
  Synthetic
gccaagcatttaggtgacactatagtttactggcatcctaaaggtgtttcagagctatgctggaaacagc

SEQ ID NO: 60529 - DNA, 70 bp, Artificial Sequence
  Synthetic
gccaagcatttaggtgacactatagaaactcacacttctgtgaacgtttcagagctatgctggaaacagc

SEQ ID NO: 60530 - DNA, 70 bp, Artificial Sequence
  Synthetic
gccaagcatttaggtgacactatagacatgatgagacacattcatgtttcagagctatgctggaaacagc

SEQ ID NO: 60531 - DNA, 70 bp, Artificial Sequence
  Synthetic
gccaagcatttaggtgacactatagacacaaccagaatgggaatcgtttcagagctatgctggaaacagc

SEQ ID NO: 60532 - DNA, 70 bp, Artificial Sequence
  Synthetic
gccaagcatttaggtgacactatagaagaaggatcactctaacatgtttcagagctatgctggaaacagc

SEQ ID NO: 60533 - DNA, 70 bp, Artificial Sequence
  Synthetic
gccaagcatttaggtgacactatagttcagaacatctcacataacgtttcagagctatgctggaaacagc

SEQ ID NO: 60534 - DNA, 70 bp, Artificial Sequence
  Synthetic
gccaagcatttaggtgacactataggaggggatcactcagcatcagtttcagagctatgctggaaacagc

SEQ ID NO: 60535 - DNA, 70 bp, Artificial Sequence
  Synthetic
gccaagcatttaggtgacactatagcccattctatccattgtcacgtttcagagctatgctggaaacagc

SEQ ID NO: 60536 - DNA, 70 bp, Artificial Sequence
  Synthetic
gccaagcatttaggtgacactatagaattgaagaggcagatgaaggtttcagagctatgctggaaacagc

SEQ ID NO: 60537 - DNA, 70 bp, Artificial Sequence
  Synthetic
gccaagcatttaggtgacactatagcagaggtctggggatcaggtgtttcagagctatgctggaaacagc

SEQ ID NO: 60538 - DNA, 70 bp, Artificial Sequence
  Synthetic
gccaagcatttaggtgacactatagagagggggattatgtatccagtttcagagctatgctggaaacagc

SEQ ID NO: 60539 - DNA, 70 bp, Artificial Sequence
  Synthetic
gccaagcatttaggtgacactatagctcgacaaccagaggacttagtttcagagctatgctggaaacagc

SEQ ID NO: 60540 - DNA, 70 bp, Artificial Sequence
  Synthetic
gccaagcatttaggtgacactatagtttttgcactgttacgtgtcgtttcagagctatgctggaaacagc

SEQ ID NO: 60541 - DNA, 70 bp, Artificial Sequence
  Synthetic
gccaagcatttaggtgacactatagcctggcccagagggacaagtgtttcagagctatgctggaaacagc

SEQ ID NO: 60542 - DNA, 70 bp, Artificial Sequence
  Synthetic
gccaagcatttaggtgacactatagcctggaaggcaagggtcacagtttcagagctatgctggaaacagc

SEQ ID NO: 60543 - DNA, 70 bp, Artificial Sequence
  Synthetic
gccaagcatttaggtgacactatagcactgacagtattgaggagggtttcagagctatgctggaaacagc

SEQ ID NO: 60544 - DNA, 70 bp, Artificial Sequence
  Synthetic
gccaagcatttaggtgacactataggtgcagctacctatctgctggtttcagagctatgctggaaacagc

SEQ ID NO: 60545 - DNA, 70 bp, Artificial Sequence
  Synthetic
gccaagcatttaggtgacactatagccaggccaagcggaactgaggtttcagagctatgctggaaacagc

SEQ ID NO: 60546 - DNA, 70 bp, Artificial Sequence
  Synthetic
gccaagcatttaggtgacactatagcacatccccagtggtgttacgtttcagagctatgctggaaacagc

SEQ ID NO: 60547 - DNA, 70 bp, Artificial Sequence
  Synthetic
gccaagcatttaggtgacactataggctatttgctacaagaggttgtttcagagctatgctggaaacagc

SEQ ID NO: 60548 - DNA, 70 bp, Artificial Sequence
  Synthetic
gccaagcatttaggtgacactatagcccatgggaccagtgctcacgtttcagagctatgctggaaacagc

SEQ ID NO: 60549 - DNA, 70 bp, Artificial Sequence
  Synthetic
gccaagcatttaggtgacactataggctgctgaagattcaggagggtttcagagctatgctggaaacagc

SEQ ID NO: 60550 - DNA, 70 bp, Artificial Sequence
  Synthetic
gccaagcatttaggtgacactatagagacgcttgctggcatcatcgtttcagagctatgctggaaacagc

SEQ ID NO: 60551 - DNA, 70 bp, Artificial Sequence
  Synthetic
gccaagcatttaggtgacactatagagtaaactttttgttccagggtttcagagctatgctggaaacagc

SEQ ID NO: 60552 - DNA, 70 bp, Artificial Sequence
  Synthetic
gccaagcatttaggtgacactatagcgtgctagatgatgccatatgtttcagagctatgctggaaacagc

SEQ ID NO: 60553 - DNA, 70 bp, Artificial Sequence
  Synthetic
gccaagcatttaggtgacactatagtgcatgagctcgctcagtttgtttcagagctatgctggaaacagc

SEQ ID NO: 60554 - DNA, 70 bp, Artificial Sequence
  Synthetic
gccaagcatttaggtgacactatagtatgataaccgattttcctggtttcagagctatgctggaaacagc

SEQ ID NO: 60555 - DNA, 70 bp, Artificial Sequence
  Synthetic
gccaagcatttaggtgacactatagtaagttgggccggcccctaggtttcagagctatgctggaaacagc

SEQ ID NO: 60556 - DNA, 70 bp, Artificial Sequence
  Synthetic
gccaagcatttaggtgacactatagccgaccacctcctgaatagtgtttcagagctatgctggaaacagc

SEQ ID NO: 60557 - DNA, 70 bp, Artificial Sequence
  Synthetic
gccaagcatttaggtgacactataggccaaatgttgcatcagggcgtttcagagctatgctggaaacagc

SEQ ID NO: 60558 - DNA, 70 bp, Artificial Sequence
  Synthetic
gccaagcatttaggtgacactataggcttggctttagctgtcagagtttcagagctatgctggaaacagc

SEQ ID NO: 60559 - DNA, 70 bp, Artificial Sequence
  Synthetic
gccaagcatttaggtgacactatagagagatgtgaaaaacagtgagtttcagagctatgctggaaacagc

SEQ ID NO: 60560 - DNA, 70 bp, Artificial Sequence
  Synthetic
gccaagcatttaggtgacactatagcacaaacgtctattggatgagtttcagagctatgctggaaacagc

SEQ ID NO: 60561 - DNA, 70 bp, Artificial Sequence
  Synthetic
gccaagcatttaggtgacactatagggattatcgggaagaggacagtttcagagctatgctggaaacagc

SEQ ID NO: 60562 - DNA, 70 bp, Artificial Sequence
  Synthetic
gccaagcatttaggtgacactatagctagggagtcaggtaaaaaagtttcagagctatgctggaaacagc

SEQ ID NO: 60563 - DNA, 70 bp, Artificial Sequence
  Synthetic
gccaagcatttaggtgacactatagaggagacccttggagcctaggtttcagagctatgctggaaacagc

SEQ ID NO: 60564 - DNA, 70 bp, Artificial Sequence
  Synthetic
gccaagcatttaggtgacactataggtgtgcagagggagcacagggtttcagagctatgctggaaacagc

SEQ ID NO: 60565 - DNA, 70 bp, Artificial Sequence
  Synthetic
gccaagcatttaggtgacactatagatgtgcacattctcttatcggtttcagagctatgctggaaacagc

SEQ ID NO: 60566 - DNA, 70 bp, Artificial Sequence
  Synthetic
gccaagcatttaggtgacactatagccctcgaatccgccagttacgtttcagagctatgctggaaacagc

SEQ ID NO: 60567 - DNA, 70 bp, Artificial Sequence
  Synthetic
gccaagcatttaggtgacactatagttttttcagatagtcacggagtttcagagctatgctggaaacagc

SEQ ID NO: 60568 - DNA, 70 bp, Artificial Sequence
  Synthetic
gccaagcatttaggtgacactatagggtaggggccagccccctacgtttcagagctatgctggaaacagc

SEQ ID NO: 60569 - DNA, 70 bp, Artificial Sequence
  Synthetic
gccaagcatttaggtgacactatagactgttgagttttcctgactgtttcagagctatgctggaaacagc

SEQ ID NO: 60570 - DNA, 70 bp, Artificial Sequence
  Synthetic
gccaagcatttaggtgacactatagaagttcgtggtgccaatcaggtttcagagctatgctggaaacagc

SEQ ID NO: 60571 - DNA, 70 bp, Artificial Sequence
  Synthetic
gccaagcatttaggtgacactatagagtttaagtccgtcagttaagtttcagagctatgctggaaacagc

SEQ ID NO: 60572 - DNA, 70 bp, Artificial Sequence
  Synthetic
gccaagcatttaggtgacactatagaatatgatgtctttgacctggtttcagagctatgctggaaacagc

SEQ ID NO: 60573 - DNA, 70 bp, Artificial Sequence
  Synthetic
gccaagcatttaggtgacactatagtctttgaggactaggcaagtgtttcagagctatgctggaaacagc

SEQ ID NO: 60574 - DNA, 70 bp, Artificial Sequence
  Synthetic
gccaagcatttaggtgacactataggggcagctacagttcctcctgtttcagagctatgctggaaacagc

SEQ ID NO: 60575 - DNA, 70 bp, Artificial Sequence
  Synthetic
gccaagcatttaggtgacactataggaagaagaagaaggcacagggtttcagagctatgctggaaacagc

SEQ ID NO: 60576 - DNA, 70 bp, Artificial Sequence
  Synthetic
gccaagcatttaggtgacactatagggaccaaggaagagctttgagtttcagagctatgctggaaacagc

SEQ ID NO: 60577 - DNA, 70 bp, Artificial Sequence
  Synthetic
gccaagcatttaggtgacactatagtgaaagactagggaaaaagagtttcagagctatgctggaaacagc

SEQ ID NO: 60578 - DNA, 70 bp, Artificial Sequence
  Synthetic
gccaagcatttaggtgacactatagatgtggagcttgatgacttagtttcagagctatgctggaaacagc

SEQ ID NO: 60579 - DNA, 70 bp, Artificial Sequence
  Synthetic
gccaagcatttaggtgacactatagtgcatttaaagatagcagctgtttcagagctatgctggaaacagc

SEQ ID NO: 60580 - DNA, 70 bp, Artificial Sequence
  Synthetic
gccaagcatttaggtgacactatagtttggtttcttcttttgcacgtttcagagctatgctggaaacagc

SEQ ID NO: 60581 - DNA, 70 bp, Artificial Sequence
  Synthetic
gccaagcatttaggtgacactatagccaagtgtgtctaggcactggtttcagagctatgctggaaacagc

SEQ ID NO: 60582 - DNA, 70 bp, Artificial Sequence
  Synthetic
gccaagcatttaggtgacactatagccacgtaccgcgtcagctaagtttcagagctatgctggaaacagc

SEQ ID NO: 60583 - DNA, 70 bp, Artificial Sequence
  Synthetic
gccaagcatttaggtgacactatagcccagggccgggctgctgaggtttcagagctatgctggaaacagc

SEQ ID NO: 60584 - DNA, 70 bp, Artificial Sequence
  Synthetic
gccaagcatttaggtgacactatagtttgtattttgaagcatcccgtttcagagctatgctggaaacagc

SEQ ID NO: 60585 - DNA, 70 bp, Artificial Sequence
  Synthetic
gccaagcatttaggtgacactatagaaagaagtggccatgtgaaggtttcagagctatgctggaaacagc

SEQ ID NO: 60586 - DNA, 70 bp, Artificial Sequence
  Synthetic
gccaagcatttaggtgacactataggtcagatctgctggctcactgtttcagagctatgctggaaacagc

SEQ ID NO: 60587 - DNA, 70 bp, Artificial Sequence
  Synthetic
gccaagcatttaggtgacactatagacctgccaccctcagctctcgtttcagagctatgctggaaacagc

SEQ ID NO: 60588 - DNA, 70 bp, Artificial Sequence
  Synthetic
gccaagcatttaggtgacactatagcagaggttgtctcaccagctgtttcagagctatgctggaaacagc

SEQ ID NO: 60589 - DNA, 70 bp, Artificial Sequence
  Synthetic
gccaagcatttaggtgacactatagcttcaggttcagcccacagtgtttcagagctatgctggaaacagc

SEQ ID NO: 60590 - DNA, 70 bp, Artificial Sequence
  Synthetic
gccaagcatttaggtgacactataggcctgcagagacttaagcttgtttcagagctatgctggaaacagc

SEQ ID NO: 60591 - DNA, 70 bp, Artificial Sequence
  Synthetic
gccaagcatttaggtgacactatagaaggtggaactcgtctgagcgtttcagagctatgctggaaacagc

SEQ ID NO: 60592 - DNA, 70 bp, Artificial Sequence
  Synthetic
gccaagcatttaggtgacactatagtgcttcatgtgcagtgactggtttcagagctatgctggaaacagc

SEQ ID NO: 60593 - DNA, 70 bp, Artificial Sequence
  Synthetic
gccaagcatttaggtgacactatagaatgagcatgtttcttacacgtttcagagctatgctggaaacagc

SEQ ID NO: 60594 - DNA, 70 bp, Artificial Sequence
  Synthetic
gccaagcatttaggtgacactatagagtataaaacagtgtgggccgtttcagagctatgctggaaacagc

SEQ ID NO: 60595 - DNA, 70 bp, Artificial Sequence
  Synthetic
gccaagcatttaggtgacactataggagcacgtgctgaaacttcagtttcagagctatgctggaaacagc

SEQ ID NO: 60596 - DNA, 70 bp, Artificial Sequence
  Synthetic
gccaagcatttaggtgacactatagtcagacctttttctccaagagtttcagagctatgctggaaacagc

SEQ ID NO: 60597 - DNA, 70 bp, Artificial Sequence
  Synthetic
gccaagcatttaggtgacactatagaggggctcacacatgagagagtttcagagctatgctggaaacagc

SEQ ID NO: 60598 - DNA, 70 bp, Artificial Sequence
  Synthetic
gccaagcatttaggtgacactatagctcaacgtgcagtcgtagccgtttcagagctatgctggaaacagc

SEQ ID NO: 60599 - DNA, 70 bp, Artificial Sequence
  Synthetic
gccaagcatttaggtgacactatagaaagagccactcactattctgtttcagagctatgctggaaacagc

SEQ ID NO: 60600 - DNA, 70 bp, Artificial Sequence
  Synthetic
gccaagcatttaggtgacactatagatcggtgcatattacaaggggtttcagagctatgctggaaacagc

SEQ ID NO: 60601 - DNA, 70 bp, Artificial Sequence
  Synthetic
gccaagcatttaggtgacactataggacgccgctgtgcagtgacggtttcagagctatgctggaaacagc

SEQ ID NO: 60602 - DNA, 70 bp, Artificial Sequence
  Synthetic
gccaagcatttaggtgacactatagtaacaggacgtattatctgagtttcagagctatgctggaaacagc

SEQ ID NO: 60603 - DNA, 70 bp, Artificial Sequence
  Synthetic
gccaagcatttaggtgacactatagttatgcgaaaaatgtcgggagtttcagagctatgctggaaacagc

SEQ ID NO: 60604 - DNA, 70 bp, Artificial Sequence
  Synthetic
gccaagcatttaggtgacactatagtggagctgagtgacttacatgtttcagagctatgctggaaacagc

SEQ ID NO: 60605 - DNA, 70 bp, Artificial Sequence
  Synthetic
gccaagcatttaggtgacactataggctctcaaggtcatcttgaagtttcagagctatgctggaaacagc

SEQ ID NO: 60606 - DNA, 70 bp, Artificial Sequence
  Synthetic
gccaagcatttaggtgacactatagaagtcaatttgtctttctgcgtttcagagctatgctggaaacagc

SEQ ID NO: 60607 - DNA, 70 bp, Artificial Sequence
  Synthetic
gccaagcatttaggtgacactatagatctgcttgtttgcaagaacgtttcagagctatgctggaaacagc

SEQ ID NO: 60608 - DNA, 70 bp, Artificial Sequence
  Synthetic
gccaagcatttaggtgacactatagggcgaagtgctaaaagggaagtttcagagctatgctggaaacagc

SEQ ID NO: 60609 - DNA, 70 bp, Artificial Sequence
  Synthetic
gccaagcatttaggtgacactatagcgagctctgtctacatctccgtttcagagctatgctggaaacagc

SEQ ID NO: 60610 - DNA, 70 bp, Artificial Sequence
  Synthetic
gccaagcatttaggtgacactatagtgaatgagggcatctctttcgtttcagagctatgctggaaacagc

SEQ ID NO: 60611 - DNA, 70 bp, Artificial Sequence
  Synthetic
gccaagcatttaggtgacactatagtaaagcagatctggcctccggtttcagagctatgctggaaacagc

SEQ ID NO: 60612 - DNA, 70 bp, Artificial Sequence
  Synthetic
gccaagcatttaggtgacactataggccgcaggaaccacgatgaggtttcagagctatgctggaaacagc

SEQ ID NO: 60613 - DNA, 70 bp, Artificial Sequence
  Synthetic
gccaagcatttaggtgacactatagtctgggtttatgcctcaagggtttcagagctatgctggaaacagc

SEQ ID NO: 60614 - DNA, 70 bp, Artificial Sequence
  Synthetic
gccaagcatttaggtgacactatagaccatccgacctgctggtgagtttcagagctatgctggaaacagc

SEQ ID NO: 60615 - DNA, 70 bp, Artificial Sequence
  Synthetic
gccaagcatttaggtgacactataggagtctcatcttaagctctcgtttcagagctatgctggaaacagc

SEQ ID NO: 60616 - DNA, 70 bp, Artificial Sequence
  Synthetic
gccaagcatttaggtgacactatagtccaggccacggtgctgtgagtttcagagctatgctggaaacagc

SEQ ID NO: 60617 - DNA, 70 bp, Artificial Sequence
  Synthetic
gccaagcatttaggtgacactatagagacttgacagaggggttgggtttcagagctatgctggaaacagc

SEQ ID NO: 60618 - DNA, 70 bp, Artificial Sequence
  Synthetic
gccaagcatttaggtgacactataggaagatccgaatgcttactcgtttcagagctatgctggaaacagc

SEQ ID NO: 60619 - DNA, 70 bp, Artificial Sequence
  Synthetic
gccaagcatttaggtgacactatagattatcatcgccaaaaagaggtttcagagctatgctggaaacagc

SEQ ID NO: 60620 - DNA, 70 bp, Artificial Sequence
  Synthetic
gccaagcatttaggtgacactatagaataactgcacaggtccttcgtttcagagctatgctggaaacagc

SEQ ID NO: 60621 - DNA, 70 bp, Artificial Sequence
  Synthetic
gccaagcatttaggtgacactatagggtgctctacagtagatccggtttcagagctatgctggaaacagc

SEQ ID NO: 60622 - DNA, 70 bp, Artificial Sequence
  Synthetic
gccaagcatttaggtgacactatagacccgcccgggcagctcacagtttcagagctatgctggaaacagc

SEQ ID NO: 60623 - DNA, 70 bp, Artificial Sequence
  Synthetic
gccaagcatttaggtgacactatagcgggtagatagcttcagtccgtttcagagctatgctggaaacagc

SEQ ID NO: 60624 - DNA, 70 bp, Artificial Sequence
  Synthetic
gccaagcatttaggtgacactataggaggttagggggagggtcatgtttcagagctatgctggaaacagc

SEQ ID NO: 60625 - DNA, 70 bp, Artificial Sequence
  Synthetic
gccaagcatttaggtgacactatagttgagactagcctgggcaacgtttcagagctatgctggaaacagc

SEQ ID NO: 60626 - DNA, 70 bp, Artificial Sequence
  Synthetic
gccaagcatttaggtgacactatagacctgtctgctacacagactgtttcagagctatgctggaaacagc

SEQ ID NO: 60627 - DNA, 70 bp, Artificial Sequence
  Synthetic
gccaagcatttaggtgacactataggcccaactggtatcaaaggtgtttcagagctatgctggaaacagc

SEQ ID NO: 60628 - DNA, 70 bp, Artificial Sequence
  Synthetic
gccaagcatttaggtgacactatagagaattggaagaagaatgtggtttcagagctatgctggaaacagc

SEQ ID NO: 60629 - DNA, 70 bp, Artificial Sequence
  Synthetic
gccaagcatttaggtgacactatagagccacagagaaggttacatgtttcagagctatgctggaaacagc

SEQ ID NO: 60630 - DNA, 70 bp, Artificial Sequence
  Synthetic
gccaagcatttaggtgacactatagattatacagtagtcaccgatgtttcagagctatgctggaaacagc

SEQ ID NO: 60631 - DNA, 70 bp, Artificial Sequence
  Synthetic
gccaagcatttaggtgacactatagccattcattcggtcatacaggtttcagagctatgctggaaacagc

SEQ ID NO: 60632 - DNA, 70 bp, Artificial Sequence
  Synthetic
gccaagcatttaggtgacactatagccccttgctcaggccttcttgtttcagagctatgctggaaacagc

SEQ ID NO: 60633 - DNA, 70 bp, Artificial Sequence
  Synthetic
gccaagcatttaggtgacactatagatcatccaggtacacattaagtttcagagctatgctggaaacagc

SEQ ID NO: 60634 - DNA, 70 bp, Artificial Sequence
  Synthetic
gccaagcatttaggtgacactatagccaggccctggcgctgctgtgtttcagagctatgctggaaacagc

SEQ ID NO: 60635 - DNA, 70 bp, Artificial Sequence
  Synthetic
gccaagcatttaggtgacactatagataccatcctggctcctcaagtttcagagctatgctggaaacagc

SEQ ID NO: 60636 - DNA, 70 bp, Artificial Sequence
  Synthetic
gccaagcatttaggtgacactataggcagctgtctgggaagtagggtttcagagctatgctggaaacagc

SEQ ID NO: 60637 - DNA, 70 bp, Artificial Sequence
  Synthetic
gccaagcatttaggtgacactatagggcaaagccggctatctagcgtttcagagctatgctggaaacagc

SEQ ID NO: 60638 - DNA, 70 bp, Artificial Sequence
  Synthetic
gccaagcatttaggtgacactatagttgctgtctaagttccatcagtttcagagctatgctggaaacagc

SEQ ID NO: 60639 - DNA, 70 bp, Artificial Sequence
  Synthetic
gccaagcatttaggtgacactataggagcttagctttctccttaagtttcagagctatgctggaaacagc

SEQ ID NO: 60640 - DNA, 70 bp, Artificial Sequence
  Synthetic
gccaagcatttaggtgacactatagtcgtcaccatgacagcttctgtttcagagctatgctggaaacagc

SEQ ID NO: 60641 - DNA, 70 bp, Artificial Sequence
  Synthetic
gccaagcatttaggtgacactatagctccccggccccgctgtagagtttcagagctatgctggaaacagc

SEQ ID NO: 60642 - DNA, 70 bp, Artificial Sequence
  Synthetic
gccaagcatttaggtgacactatagaggacatgacaggtatttacgtttcagagctatgctggaaacagc

SEQ ID NO: 60643 - DNA, 70 bp, Artificial Sequence
  Synthetic
gccaagcatttaggtgacactatagagaatacccacactggctgagtttcagagctatgctggaaacagc

SEQ ID NO: 60644 - DNA, 70 bp, Artificial Sequence
  Synthetic
gccaagcatttaggtgacactatagacaatggtctgttagtctaggtttcagagctatgctggaaacagc

SEQ ID NO: 60645 - DNA, 70 bp, Artificial Sequence
  Synthetic
gccaagcatttaggtgacactatagtgtcaagggcgtcagtcaatgtttcagagctatgctggaaacagc

SEQ ID NO: 60646 - DNA, 70 bp, Artificial Sequence
  Synthetic
gccaagcatttaggtgacactatagtttccagggcccgctggattgtttcagagctatgctggaaacagc

SEQ ID NO: 60647 - DNA, 70 bp, Artificial Sequence
  Synthetic
gccaagcatttaggtgacactataggggtgattccagttctgaaggtttcagagctatgctggaaacagc

SEQ ID NO: 60648 - DNA, 70 bp, Artificial Sequence
  Synthetic
gccaagcatttaggtgacactataggcagaagatggctaggagtcgtttcagagctatgctggaaacagc

SEQ ID NO: 60649 - DNA, 70 bp, Artificial Sequence
  Synthetic
gccaagcatttaggtgacactatagagctcaatcagctcctcttggtttcagagctatgctggaaacagc

SEQ ID NO: 60650 - DNA, 70 bp, Artificial Sequence
  Synthetic
gccaagcatttaggtgacactatagtttctgccggtagatctcaggtttcagagctatgctggaaacagc

SEQ ID NO: 60651 - DNA, 70 bp, Artificial Sequence
  Synthetic
gccaagcatttaggtgacactatagctccaaagaagttcctgaaagtttcagagctatgctggaaacagc

SEQ ID NO: 60652 - DNA, 70 bp, Artificial Sequence
  Synthetic
gccaagcatttaggtgacactataggatttctggctggctctactgtttcagagctatgctggaaacagc

SEQ ID NO: 60653 - DNA, 70 bp, Artificial Sequence
  Synthetic
gccaagcatttaggtgacactataggtcccagaatggagtctagcgtttcagagctatgctggaaacagc

SEQ ID NO: 60654 - DNA, 70 bp, Artificial Sequence
  Synthetic
gccaagcatttaggtgacactatagatggatcccccttgaatcacgtttcagagctatgctggaaacagc

SEQ ID NO: 60655 - DNA, 70 bp, Artificial Sequence
  Synthetic
gccaagcatttaggtgacactatagcacatcctgtggtcaggttcgtttcagagctatgctggaaacagc

SEQ ID NO: 60656 - DNA, 70 bp, Artificial Sequence
  Synthetic
gccaagcatttaggtgacactatagcagccccagccccagctcctgtttcagagctatgctggaaacagc

SEQ ID NO: 60657 - DNA, 70 bp, Artificial Sequence
  Synthetic
gccaagcatttaggtgacactatagttctacacatctgcctaactgtttcagagctatgctggaaacagc

SEQ ID NO: 60658 - DNA, 70 bp, Artificial Sequence
  Synthetic
gccaagcatttaggtgacactatagggggccgcaggcactcactcgtttcagagctatgctggaaacagc

SEQ ID NO: 60659 - DNA, 70 bp, Artificial Sequence
  Synthetic
gccaagcatttaggtgacactataggacgcccagcagaactcctggtttcagagctatgctggaaacagc

SEQ ID NO: 60660 - DNA, 70 bp, Artificial Sequence
  Synthetic
gccaagcatttaggtgacactatagatttgtcaattcctgtgtgagtttcagagctatgctggaaacagc

SEQ ID NO: 60661 - DNA, 70 bp, Artificial Sequence
  Synthetic
gccaagcatttaggtgacactataggctaaagttactttctgtccgtttcagagctatgctggaaacagc

SEQ ID NO: 60662 - DNA, 70 bp, Artificial Sequence
  Synthetic
gccaagcatttaggtgacactatagcttcggcactaccgctgagcgtttcagagctatgctggaaacagc

SEQ ID NO: 60663 - DNA, 70 bp, Artificial Sequence
  Synthetic
gccaagcatttaggtgacactatagcaagcctaaaaacaccctaagtttcagagctatgctggaaacagc

SEQ ID NO: 60664 - DNA, 70 bp, Artificial Sequence
  Synthetic
gccaagcatttaggtgacactatagtcagggcttgagtcgtagccgtttcagagctatgctggaaacagc

SEQ ID NO: 60665 - DNA, 70 bp, Artificial Sequence
  Synthetic
gccaagcatttaggtgacactatagtgctcttccggcagtgtcaggtttcagagctatgctggaaacagc

SEQ ID NO: 60666 - DNA, 70 bp, Artificial Sequence
  Synthetic
gccaagcatttaggtgacactatagtactcccctgagaactgaaagtttcagagctatgctggaaacagc

SEQ ID NO: 60667 - DNA, 70 bp, Artificial Sequence
  Synthetic
gccaagcatttaggtgacactatagcctgattccattgggaaagagtttcagagctatgctggaaacagc

SEQ ID NO: 60668 - DNA, 70 bp, Artificial Sequence
  Synthetic
gccaagcatttaggtgacactatagaacgagagtgagcgggactagtttcagagctatgctggaaacagc

SEQ ID NO: 60669 - DNA, 70 bp, Artificial Sequence
  Synthetic
gccaagcatttaggtgacactataggtagaagtagattttctgccgtttcagagctatgctggaaacagc

SEQ ID NO: 60670 - DNA, 70 bp, Artificial Sequence
  Synthetic
gccaagcatttaggtgacactatagtcacaggagagcgcagtcaagtttcagagctatgctggaaacagc

SEQ ID NO: 60671 - DNA, 70 bp, Artificial Sequence
  Synthetic
gccaagcatttaggtgacactataggatcagacactgttcaccacgtttcagagctatgctggaaacagc

SEQ ID NO: 60672 - DNA, 70 bp, Artificial Sequence
  Synthetic
gccaagcatttaggtgacactatagagtctgcagccactgaaatcgtttcagagctatgctggaaacagc

SEQ ID NO: 60673 - DNA, 70 bp, Artificial Sequence
  Synthetic
gccaagcatttaggtgacactatagagctccgcatccgtgactgagtttcagagctatgctggaaacagc

SEQ ID NO: 60674 - DNA, 70 bp, Artificial Sequence
  Synthetic
gccaagcatttaggtgacactatagttttagtacccctcagcaacgtttcagagctatgctggaaacagc

SEQ ID NO: 60675 - DNA, 70 bp, Artificial Sequence
  Synthetic
gccaagcatttaggtgacactataggcagcccgtcccactgtcacgtttcagagctatgctggaaacagc

SEQ ID NO: 60676 - DNA, 70 bp, Artificial Sequence
  Synthetic
gccaagcatttaggtgacactatagcctcttaagagctttcaactgtttcagagctatgctggaaacagc

SEQ ID NO: 60677 - DNA, 70 bp, Artificial Sequence
  Synthetic
gccaagcatttaggtgacactataggaccctggggggctcctagcgtttcagagctatgctggaaacagc

SEQ ID NO: 60678 - DNA, 70 bp, Artificial Sequence
  Synthetic
gccaagcatttaggtgacactatagcaaagtagtgtatctcaagcgtttcagagctatgctggaaacagc

SEQ ID NO: 60679 - DNA, 70 bp, Artificial Sequence
  Synthetic
gccaagcatttaggtgacactatagtcttgtacagcggggcttgcgtttcagagctatgctggaaacagc

SEQ ID NO: 60680 - DNA, 70 bp, Artificial Sequence
  Synthetic
gccaagcatttaggtgacactataggaatgggaggaaaatttgctgtttcagagctatgctggaaacagc

SEQ ID NO: 60681 - DNA, 70 bp, Artificial Sequence
  Synthetic
gccaagcatttaggtgacactatagcctggaagggagctgctgacgtttcagagctatgctggaaacagc

SEQ ID NO: 60682 - DNA, 70 bp, Artificial Sequence
  Synthetic
gccaagcatttaggtgacactatagggaagctgagcgttagtcaagtttcagagctatgctggaaacagc

SEQ ID NO: 60683 - DNA, 70 bp, Artificial Sequence
  Synthetic
gccaagcatttaggtgacactataggctggagtgttggtctcctagtttcagagctatgctggaaacagc

SEQ ID NO: 60684 - DNA, 70 bp, Artificial Sequence
  Synthetic
gccaagcatttaggtgacactatagtcgctgaattgattccactcgtttcagagctatgctggaaacagc

SEQ ID NO: 60685 - DNA, 70 bp, Artificial Sequence
  Synthetic
gccaagcatttaggtgacactatagggcagctcaggctactgctagtttcagagctatgctggaaacagc

SEQ ID NO: 60686 - DNA, 70 bp, Artificial Sequence
  Synthetic
gccaagcatttaggtgacactatagccatggggtcaggccttgccgtttcagagctatgctggaaacagc

SEQ ID NO: 60687 - DNA, 70 bp, Artificial Sequence
  Synthetic
gccaagcatttaggtgacactatagtcttggaaagggctcagtaggtttcagagctatgctggaaacagc

SEQ ID NO: 60688 - DNA, 70 bp, Artificial Sequence
  Synthetic
gccaagcatttaggtgacactataggaacatccacatcattagcagtttcagagctatgctggaaacagc

SEQ ID NO: 60689 - DNA, 70 bp, Artificial Sequence
  Synthetic
gccaagcatttaggtgacactataggacttgggtcttcggctagtgtttcagagctatgctggaaacagc

SEQ ID NO: 60690 - DNA, 70 bp, Artificial Sequence
  Synthetic
gccaagcatttaggtgacactataggactcctccaggaaacactggtttcagagctatgctggaaacagc

SEQ ID NO: 60691 - DNA, 70 bp, Artificial Sequence
  Synthetic
gccaagcatttaggtgacactatagagacaggcttgccctagcaagtttcagagctatgctggaaacagc

SEQ ID NO: 60692 - DNA, 70 bp, Artificial Sequence
  Synthetic
gccaagcatttaggtgacactatagcagtggatgaacatggtcacgtttcagagctatgctggaaacagc

SEQ ID NO: 60693 - DNA, 70 bp, Artificial Sequence
  Synthetic
gccaagcatttaggtgacactatagagcatggacaagggcttctggtttcagagctatgctggaaacagc

SEQ ID NO: 60694 - DNA, 70 bp, Artificial Sequence
  Synthetic
gccaagcatttaggtgacactatagtcactccagagaggtttagagtttcagagctatgctggaaacagc

SEQ ID NO: 60695 - DNA, 70 bp, Artificial Sequence
  Synthetic
gccaagcatttaggtgacactataggggactgggtcagacactccgtttcagagctatgctggaaacagc

SEQ ID NO: 60696 - DNA, 70 bp, Artificial Sequence
  Synthetic
gccaagcatttaggtgacactataggggacagacgaggtcagtacgtttcagagctatgctggaaacagc

SEQ ID NO: 60697 - DNA, 70 bp, Artificial Sequence
  Synthetic
gccaagcatttaggtgacactatagcttacacatcagacctcctcgtttcagagctatgctggaaacagc

SEQ ID NO: 60698 - DNA, 70 bp, Artificial Sequence
  Synthetic
gccaagcatttaggtgacactataggcaaaatacttgagagactcgtttcagagctatgctggaaacagc

SEQ ID NO: 60699 - DNA, 70 bp, Artificial Sequence
  Synthetic
gccaagcatttaggtgacactataggcgcatgcagggcgcctagcgtttcagagctatgctggaaacagc

SEQ ID NO: 60700 - DNA, 70 bp, Artificial Sequence
  Synthetic
gccaagcatttaggtgacactataggtggaagccacagagagcctgtttcagagctatgctggaaacagc

SEQ ID NO: 60701 - DNA, 70 bp, Artificial Sequence
  Synthetic
gccaagcatttaggtgacactatagagagacttaggcttaagccagtttcagagctatgctggaaacagc

SEQ ID NO: 60702 - DNA, 70 bp, Artificial Sequence
  Synthetic
gccaagcatttaggtgacactataggagacttaggcttaagccacgtttcagagctatgctggaaacagc

SEQ ID NO: 60703 - DNA, 70 bp, Artificial Sequence
  Synthetic
gccaagcatttaggtgacactatagagggcaaggccaagaagtgagtttcagagctatgctggaaacagc

SEQ ID NO: 60704 - DNA, 70 bp, Artificial Sequence
  Synthetic
gccaagcatttaggtgacactatagccagggcaaggccaagtgaggtttcagagctatgctggaaacagc

SEQ ID NO: 60705 - DNA, 70 bp, Artificial Sequence
  Synthetic
gccaagcatttaggtgacactatagacaagatcactcgatcctgagtttcagagctatgctggaaacagc

SEQ ID NO: 60706 - DNA, 70 bp, Artificial Sequence
  Synthetic
gccaagcatttaggtgacactatagctggggattttgtgcttctggtttcagagctatgctggaaacagc

SEQ ID NO: 60707 - DNA, 70 bp, Artificial Sequence
  Synthetic
gccaagcatttaggtgacactatagagaggaatgaagacaaagcagtttcagagctatgctggaaacagc

SEQ ID NO: 60708 - DNA, 70 bp, Artificial Sequence
  Synthetic
gccaagcatttaggtgacactataggttcagaatcgcttttcctcgtttcagagctatgctggaaacagc

SEQ ID NO: 60709 - DNA, 70 bp, Artificial Sequence
  Synthetic
gccaagcatttaggtgacactatagtcggcacaacatgtattgtggtttcagagctatgctggaaacagc

SEQ ID NO: 60710 - DNA, 70 bp, Artificial Sequence
  Synthetic
gccaagcatttaggtgacactatagagggggtgggtgtgttagcggtttcagagctatgctggaaacagc

SEQ ID NO: 60711 - DNA, 70 bp, Artificial Sequence
  Synthetic
gccaagcatttaggtgacactatagatcagaggacaagttcaagcgtttcagagctatgctggaaacagc

SEQ ID NO: 60712 - DNA, 70 bp, Artificial Sequence
  Synthetic
gccaagcatttaggtgacactatagaatgctcatctgtcagattagtttcagagctatgctggaaacagc

SEQ ID NO: 60713 - DNA, 70 bp, Artificial Sequence
  Synthetic
gccaagcatttaggtgacactatagagcatgtctcatgatgtcacgtttcagagctatgctggaaacagc

SEQ ID NO: 60714 - DNA, 70 bp, Artificial Sequence
  Synthetic
gccaagcatttaggtgacactatagtgaatatcacactgaatagcgtttcagagctatgctggaaacagc

SEQ ID NO: 60715 - DNA, 70 bp, Artificial Sequence
  Synthetic
gccaagcatttaggtgacactatagaagcacggaacaacacaaaggtttcagagctatgctggaaacagc

SEQ ID NO: 60716 - DNA, 70 bp, Artificial Sequence
  Synthetic
gccaagcatttaggtgacactatagtcctgcgcccccagcatcaggtttcagagctatgctggaaacagc

SEQ ID NO: 60717 - DNA, 70 bp, Artificial Sequence
  Synthetic
gccaagcatttaggtgacactatagcagcatcattcgggagcctggtttcagagctatgctggaaacagc

SEQ ID NO: 60718 - DNA, 70 bp, Artificial Sequence
  Synthetic
gccaagcatttaggtgacactataggtcgaggcagcaagtctagggtttcagagctatgctggaaacagc

SEQ ID NO: 60719 - DNA, 70 bp, Artificial Sequence
  Synthetic
gccaagcatttaggtgacactatagtgatcaggcattgtatgacggtttcagagctatgctggaaacagc

SEQ ID NO: 60720 - DNA, 70 bp, Artificial Sequence
  Synthetic
gccaagcatttaggtgacactatagtccaaggggtgggttacctcgtttcagagctatgctggaaacagc

SEQ ID NO: 60721 - DNA, 70 bp, Artificial Sequence
  Synthetic
gccaagcatttaggtgacactataggaccctgcctctgaataatcgtttcagagctatgctggaaacagc

SEQ ID NO: 60722 - DNA, 70 bp, Artificial Sequence
  Synthetic
gccaagcatttaggtgacactatagtgagcattgtttagagtcctgtttcagagctatgctggaaacagc

SEQ ID NO: 60723 - DNA, 70 bp, Artificial Sequence
  Synthetic
gccaagcatttaggtgacactatagttgctgagagcatccaccccgtttcagagctatgctggaaacagc

SEQ ID NO: 60724 - DNA, 70 bp, Artificial Sequence
  Synthetic
gccaagcatttaggtgacactatagtaaaatccttcctggagtaggtttcagagctatgctggaaacagc

SEQ ID NO: 60725 - DNA, 70 bp, Artificial Sequence
  Synthetic
gccaagcatttaggtgacactataggaagcattccactttgtagcgtttcagagctatgctggaaacagc

SEQ ID NO: 60726 - DNA, 70 bp, Artificial Sequence
  Synthetic
gccaagcatttaggtgacactataggcggatcagcagggcctcaggtttcagagctatgctggaaacagc

SEQ ID NO: 60727 - DNA, 70 bp, Artificial Sequence
  Synthetic
gccaagcatttaggtgacactatagtgtttccatgctgtctttatgtttcagagctatgctggaaacagc

SEQ ID NO: 60728 - DNA, 70 bp, Artificial Sequence
  Synthetic
gccaagcatttaggtgacactatagggcctcatttcaagcactgagtttcagagctatgctggaaacagc

SEQ ID NO: 60729 - DNA, 70 bp, Artificial Sequence
  Synthetic
gccaagcatttaggtgacactatagttctctcagtgtttgaaatggtttcagagctatgctggaaacagc

SEQ ID NO: 60730 - DNA, 70 bp, Artificial Sequence
  Synthetic
gccaagcatttaggtgacactataggtcttcttaggtgatgacaggtttcagagctatgctggaaacagc

SEQ ID NO: 60731 - DNA, 70 bp, Artificial Sequence
  Synthetic
gccaagcatttaggtgacactatagggctgcagattgtacttctggtttcagagctatgctggaaacagc

SEQ ID NO: 60732 - DNA, 70 bp, Artificial Sequence
  Synthetic
gccaagcatttaggtgacactatagtgatctggcgttctgtttaggtttcagagctatgctggaaacagc

SEQ ID NO: 60733 - DNA, 70 bp, Artificial Sequence
  Synthetic
gccaagcatttaggtgacactatagatgaacatacagtgccgtgagtttcagagctatgctggaaacagc

SEQ ID NO: 60734 - DNA, 70 bp, Artificial Sequence
  Synthetic
gccaagcatttaggtgacactatagattatcttcagaaacctggtgtttcagagctatgctggaaacagc

SEQ ID NO: 60735 - DNA, 70 bp, Artificial Sequence
  Synthetic
gccaagcatttaggtgacactatagccaagctcacttcatgtgcagtttcagagctatgctggaaacagc

SEQ ID NO: 60736 - DNA, 70 bp, Artificial Sequence
  Synthetic
gccaagcatttaggtgacactatagctctattcaggtgatgacaggtttcagagctatgctggaaacagc

SEQ ID NO: 60737 - DNA, 70 bp, Artificial Sequence
  Synthetic
gccaagcatttaggtgacactataggaccttttgcctgcccttcagtttcagagctatgctggaaacagc

SEQ ID NO: 60738 - DNA, 70 bp, Artificial Sequence
  Synthetic
gccaagcatttaggtgacactatagactattgccacaaacactgagtttcagagctatgctggaaacagc

SEQ ID NO: 60739 - DNA, 70 bp, Artificial Sequence
  Synthetic
gccaagcatttaggtgacactatagcaacgcggaccagctgggcagtttcagagctatgctggaaacagc

SEQ ID NO: 60740 - DNA, 70 bp, Artificial Sequence
  Synthetic
gccaagcatttaggtgacactatagtctgcctggggctgggctctgtttcagagctatgctggaaacagc

SEQ ID NO: 60741 - DNA, 70 bp, Artificial Sequence
  Synthetic
gccaagcatttaggtgacactatagtctgcttttctgctcgttgcgtttcagagctatgctggaaacagc

SEQ ID NO: 60742 - DNA, 70 bp, Artificial Sequence
  Synthetic
gccaagcatttaggtgacactatagccagccaaagggaactgaccgtttcagagctatgctggaaacagc

SEQ ID NO: 60743 - DNA, 70 bp, Artificial Sequence
  Synthetic
gccaagcatttaggtgacactatagacccaagatattggcagggagtttcagagctatgctggaaacagc

SEQ ID NO: 60744 - DNA, 70 bp, Artificial Sequence
  Synthetic
gccaagcatttaggtgacactatagaaccaaaagatgagagtgccgtttcagagctatgctggaaacagc

SEQ ID NO: 60745 - DNA, 70 bp, Artificial Sequence
  Synthetic
gccaagcatttaggtgacactatagagtgatggcggctggtgatggtttcagagctatgctggaaacagc

SEQ ID NO: 60746 - DNA, 70 bp, Artificial Sequence
  Synthetic
gccaagcatttaggtgacactatagctgatcaagaacttcttctggtttcagagctatgctggaaacagc

SEQ ID NO: 60747 - DNA, 70 bp, Artificial Sequence
  Synthetic
gccaagcatttaggtgacactatagaggaattcgactgttaaggtgtttcagagctatgctggaaacagc

SEQ ID NO: 60748 - DNA, 70 bp, Artificial Sequence
  Synthetic
gccaagcatttaggtgacactatagaagagagtcgacagtttacagtttcagagctatgctggaaacagc

SEQ ID NO: 60749 - DNA, 70 bp, Artificial Sequence
  Synthetic
gccaagcatttaggtgacactatagaagaaaatctctatggcctggtttcagagctatgctggaaacagc

SEQ ID NO: 60750 - DNA, 70 bp, Artificial Sequence
  Synthetic
gccaagcatttaggtgacactatagacctttggcatcatggacgagtttcagagctatgctggaaacagc

SEQ ID NO: 60751 - DNA, 70 bp, Artificial Sequence
  Synthetic
gccaagcatttaggtgacactatagagaagccaagttggaggcaggtttcagagctatgctggaaacagc

SEQ ID NO: 60752 - DNA, 70 bp, Artificial Sequence
  Synthetic
gccaagcatttaggtgacactatagcaggcagggtgggccctcacgtttcagagctatgctggaaacagc

SEQ ID NO: 60753 - DNA, 70 bp, Artificial Sequence
  Synthetic
gccaagcatttaggtgacactatagctcatttcttacccttgatggtttcagagctatgctggaaacagc

SEQ ID NO: 60754 - DNA, 70 bp, Artificial Sequence
  Synthetic
gccaagcatttaggtgacactataggtcctcaaggagacctaagggtttcagagctatgctggaaacagc

SEQ ID NO: 60755 - DNA, 70 bp, Artificial Sequence
  Synthetic
gccaagcatttaggtgacactatagagcatgctcaaggactcctagtttcagagctatgctggaaacagc

SEQ ID NO: 60756 - DNA, 70 bp, Artificial Sequence
  Synthetic
gccaagcatttaggtgacactatagctctctgaaggaatcttaacgtttcagagctatgctggaaacagc

SEQ ID NO: 60757 - DNA, 70 bp, Artificial Sequence
  Synthetic
gccaagcatttaggtgacactatagcataactcaggaagaagagcgtttcagagctatgctggaaacagc

SEQ ID NO: 60758 - DNA, 70 bp, Artificial Sequence
  Synthetic
gccaagcatttaggtgacactatagtcctgccgactctggtagctgtttcagagctatgctggaaacagc

SEQ ID NO: 60759 - DNA, 70 bp, Artificial Sequence
  Synthetic
gccaagcatttaggtgacactatagaagatgaggcagtcatcgaggtttcagagctatgctggaaacagc

SEQ ID NO: 60760 - DNA, 70 bp, Artificial Sequence
  Synthetic
gccaagcatttaggtgacactatagctggttgagtggggaggagggtttcagagctatgctggaaacagc

SEQ ID NO: 60761 - DNA, 70 bp, Artificial Sequence
  Synthetic
gccaagcatttaggtgacactatagagggggaaaaacagcaaagagtttcagagctatgctggaaacagc

SEQ ID NO: 60762 - DNA, 70 bp, Artificial Sequence
  Synthetic
gccaagcatttaggtgacactatagacggtaatccctaataagacgtttcagagctatgctggaaacagc

SEQ ID NO: 60763 - DNA, 70 bp, Artificial Sequence
  Synthetic
gccaagcatttaggtgacactatagcaagtctgatcagaaagctggtttcagagctatgctggaaacagc

SEQ ID NO: 60764 - DNA, 70 bp, Artificial Sequence
  Synthetic
gccaagcatttaggtgacactataggcgctccaactctgttccttgtttcagagctatgctggaaacagc

SEQ ID NO: 60765 - DNA, 70 bp, Artificial Sequence
  Synthetic
gccaagcatttaggtgacactatagtgctcagccttgggttgattgtttcagagctatgctggaaacagc

SEQ ID NO: 60766 - DNA, 70 bp, Artificial Sequence
  Synthetic
gccaagcatttaggtgacactatagcgccagccagcagtcagtccgtttcagagctatgctggaaacagc

SEQ ID NO: 60767 - DNA, 70 bp, Artificial Sequence
  Synthetic
gccaagcatttaggtgacactatagggcagagttgggtctcatgagtttcagagctatgctggaaacagc

SEQ ID NO: 60768 - DNA, 70 bp, Artificial Sequence
  Synthetic
gccaagcatttaggtgacactatagcccccgggggctagtcagtagtttcagagctatgctggaaacagc

SEQ ID NO: 60769 - DNA, 70 bp, Artificial Sequence
  Synthetic
gccaagcatttaggtgacactatagctcagggagtctacaaatccgtttcagagctatgctggaaacagc

SEQ ID NO: 60770 - DNA, 70 bp, Artificial Sequence
  Synthetic
gccaagcatttaggtgacactatagctggtcagcactgcccgctagtttcagagctatgctggaaacagc

SEQ ID NO: 60771 - DNA, 70 bp, Artificial Sequence
  Synthetic
gccaagcatttaggtgacactatagcctggctttccaaatcttaagtttcagagctatgctggaaacagc

SEQ ID NO: 60772 - DNA, 70 bp, Artificial Sequence
  Synthetic
gccaagcatttaggtgacactatagagtttcatgttgagcagcaggtttcagagctatgctggaaacagc

SEQ ID NO: 60773 - DNA, 70 bp, Artificial Sequence
  Synthetic
gccaagcatttaggtgacactatagaaacagctcctaattgacatgtttcagagctatgctggaaacagc

SEQ ID NO: 60774 - DNA, 70 bp, Artificial Sequence
  Synthetic
gccaagcatttaggtgacactatagatgctggagcaggtatgaaagtttcagagctatgctggaaacagc

SEQ ID NO: 60775 - DNA, 70 bp, Artificial Sequence
  Synthetic
gccaagcatttaggtgacactataggttatttagtctcttcccccgtttcagagctatgctggaaacagc

SEQ ID NO: 60776 - DNA, 70 bp, Artificial Sequence
  Synthetic
gccaagcatttaggtgacactatagtggtccctcggggtcagttggtttcagagctatgctggaaacagc

SEQ ID NO: 60777 - DNA, 70 bp, Artificial Sequence
  Synthetic
gccaagcatttaggtgacactatagccaaatctggagagccctgagtttcagagctatgctggaaacagc

SEQ ID NO: 60778 - DNA, 70 bp, Artificial Sequence
  Synthetic
gccaagcatttaggtgacactatagctgaagcccccaggatagcagtttcagagctatgctggaaacagc

SEQ ID NO: 60779 - DNA, 70 bp, Artificial Sequence
  Synthetic
gccaagcatttaggtgacactatagcacacacacctgttgccatggtttcagagctatgctggaaacagc

SEQ ID NO: 60780 - DNA, 70 bp, Artificial Sequence
  Synthetic
gccaagcatttaggtgacactatagtgcttttagttctgtcagtggtttcagagctatgctggaaacagc

SEQ ID NO: 60781 - DNA, 70 bp, Artificial Sequence
  Synthetic
gccaagcatttaggtgacactatagcggcttcaagaagaggtgatgtttcagagctatgctggaaacagc

SEQ ID NO: 60782 - DNA, 70 bp, Artificial Sequence
  Synthetic
gccaagcatttaggtgacactataggcagcaacttaatggaaactgtttcagagctatgctggaaacagc

SEQ ID NO: 60783 - DNA, 70 bp, Artificial Sequence
  Synthetic
gccaagcatttaggtgacactataggtacttcaggagattaaacggtttcagagctatgctggaaacagc

SEQ ID NO: 60784 - DNA, 70 bp, Artificial Sequence
  Synthetic
gccaagcatttaggtgacactataggctactcagaaggtgttactgtttcagagctatgctggaaacagc

SEQ ID NO: 60785 - DNA, 70 bp, Artificial Sequence
  Synthetic
gccaagcatttaggtgacactataggaagagacgcccatccgtgagtttcagagctatgctggaaacagc

SEQ ID NO: 60786 - DNA, 70 bp, Artificial Sequence
  Synthetic
gccaagcatttaggtgacactatagaagctctcattaactgactcgtttcagagctatgctggaaacagc

SEQ ID NO: 60787 - DNA, 70 bp, Artificial Sequence
  Synthetic
gccaagcatttaggtgacactatagatcctgaaaatccacagaaagtttcagagctatgctggaaacagc

SEQ ID NO: 60788 - DNA, 70 bp, Artificial Sequence
  Synthetic
gccaagcatttaggtgacactataggtgagctccaaggttagaaggtttcagagctatgctggaaacagc

SEQ ID NO: 60789 - DNA, 70 bp, Artificial Sequence
  Synthetic
gccaagcatttaggtgacactatagtgcccagctgacctggaatggtttcagagctatgctggaaacagc

SEQ ID NO: 60790 - DNA, 70 bp, Artificial Sequence
  Synthetic
gccaagcatttaggtgacactatagacttttggaacttctagtaggtttcagagctatgctggaaacagc

SEQ ID NO: 60791 - DNA, 70 bp, Artificial Sequence
  Synthetic
gccaagcatttaggtgacactataggcatctgtgccatgcaatgagtttcagagctatgctggaaacagc

SEQ ID NO: 60792 - DNA, 70 bp, Artificial Sequence
  Synthetic
gccaagcatttaggtgacactatagtcgggctgccagatgcaatagtttcagagctatgctggaaacagc

SEQ ID NO: 60793 - DNA, 70 bp, Artificial Sequence
  Synthetic
gccaagcatttaggtgacactatagccgtgtctgattagctagtggtttcagagctatgctggaaacagc

SEQ ID NO: 60794 - DNA, 70 bp, Artificial Sequence
  Synthetic
gccaagcatttaggtgacactatagggccgaggaggactactgaggtttcagagctatgctggaaacagc

SEQ ID NO: 60795 - DNA, 70 bp, Artificial Sequence
  Synthetic
gccaagcatttaggtgacactataggcagtggattggaaagctgagtttcagagctatgctggaaacagc

SEQ ID NO: 60796 - DNA, 70 bp, Artificial Sequence
  Synthetic
gccaagcatttaggtgacactatagggccgtgcttgtgctgggctgtttcagagctatgctggaaacagc

SEQ ID NO: 60797 - DNA, 70 bp, Artificial Sequence
  Synthetic
gccaagcatttaggtgacactatagacctccaactctgcctgaaagtttcagagctatgctggaaacagc

SEQ ID NO: 60798 - DNA, 70 bp, Artificial Sequence
  Synthetic
gccaagcatttaggtgacactatagggatcctcgctccgttgcacgtttcagagctatgctggaaacagc

SEQ ID NO: 60799 - DNA, 70 bp, Artificial Sequence
  Synthetic
gccaagcatttaggtgacactatagcactgcggtgttcggcctgagtttcagagctatgctggaaacagc

SEQ ID NO: 60800 - DNA, 70 bp, Artificial Sequence
  Synthetic
gccaagcatttaggtgacactataggtcattgtcacaggggctgagtttcagagctatgctggaaacagc

SEQ ID NO: 60801 - DNA, 70 bp, Artificial Sequence
  Synthetic
gccaagcatttaggtgacactataggttatagttacgggggcagagtttcagagctatgctggaaacagc

SEQ ID NO: 60802 - DNA, 70 bp, Artificial Sequence
  Synthetic
gccaagcatttaggtgacactatagaagagggcggggccactcaggtttcagagctatgctggaaacagc

SEQ ID NO: 60803 - DNA, 70 bp, Artificial Sequence
  Synthetic
gccaagcatttaggtgacactatagacagctcggctgggtcataggtttcagagctatgctggaaacagc

SEQ ID NO: 60804 - DNA, 70 bp, Artificial Sequence
  Synthetic
gccaagcatttaggtgacactatagagtgctgtgtcgaactcctcgtttcagagctatgctggaaacagc

SEQ ID NO: 60805 - DNA, 70 bp, Artificial Sequence
  Synthetic
gccaagcatttaggtgacactatagacgacttcagcacctgttgcgtttcagagctatgctggaaacagc

SEQ ID NO: 60806 - DNA, 70 bp, Artificial Sequence
  Synthetic
gccaagcatttaggtgacactatagtctgttgtagtttggtcctcgtttcagagctatgctggaaacagc

SEQ ID NO: 60807 - DNA, 70 bp, Artificial Sequence
  Synthetic
gccaagcatttaggtgacactatagggccggcagctagaagagatgtttcagagctatgctggaaacagc

SEQ ID NO: 60808 - DNA, 70 bp, Artificial Sequence
  Synthetic
gccaagcatttaggtgacactatagaagagcagtatgttctgatcgtttcagagctatgctggaaacagc

SEQ ID NO: 60809 - DNA, 70 bp, Artificial Sequence
  Synthetic
gccaagcatttaggtgacactataggaggtcacctgggctaacgagtttcagagctatgctggaaacagc

SEQ ID NO: 60810 - DNA, 70 bp, Artificial Sequence
  Synthetic
gccaagcatttaggtgacactatagtctcagttgaaatggcgtgcgtttcagagctatgctggaaacagc

SEQ ID NO: 60811 - DNA, 70 bp, Artificial Sequence
  Synthetic
gccaagcatttaggtgacactatagacgcagggggccgagggctggtttcagagctatgctggaaacagc

SEQ ID NO: 60812 - DNA, 70 bp, Artificial Sequence
  Synthetic
gccaagcatttaggtgacactatagagagaacaaaagcaactcaagtttcagagctatgctggaaacagc

SEQ ID NO: 60813 - DNA, 70 bp, Artificial Sequence
  Synthetic
gccaagcatttaggtgacactataggttatcctttctgctgtctcgtttcagagctatgctggaaacagc

SEQ ID NO: 60814 - DNA, 70 bp, Artificial Sequence
  Synthetic
gccaagcatttaggtgacactatagtgctttcatttgttgtgctcgtttcagagctatgctggaaacagc

SEQ ID NO: 60815 - DNA, 70 bp, Artificial Sequence
  Synthetic
gccaagcatttaggtgacactatagggacttctgaaggtgttcttgtttcagagctatgctggaaacagc

SEQ ID NO: 60816 - DNA, 70 bp, Artificial Sequence
  Synthetic
gccaagcatttaggtgacactatagggtgttatcagtgacttgctgtttcagagctatgctggaaacagc

SEQ ID NO: 60817 - DNA, 70 bp, Artificial Sequence
  Synthetic
gccaagcatttaggtgacactatagtttcgagctcgacttgtgaagtttcagagctatgctggaaacagc

SEQ ID NO: 60818 - DNA, 70 bp, Artificial Sequence
  Synthetic
gccaagcatttaggtgacactatagttacagcccacagcttcaccgtttcagagctatgctggaaacagc

SEQ ID NO: 60819 - DNA, 70 bp, Artificial Sequence
  Synthetic
gccaagcatttaggtgacactatagttccccaactgtacacctaagtttcagagctatgctggaaacagc

SEQ ID NO: 60820 - DNA, 70 bp, Artificial Sequence
  Synthetic
gccaagcatttaggtgacactatagagctccccaggagtccctaggtttcagagctatgctggaaacagc

SEQ ID NO: 60821 - DNA, 70 bp, Artificial Sequence
  Synthetic
gccaagcatttaggtgacactatagacgtccaacactgatattacgtttcagagctatgctggaaacagc

SEQ ID NO: 60822 - DNA, 70 bp, Artificial Sequence
  Synthetic
gccaagcatttaggtgacactataggagcagggctggcttagggcgtttcagagctatgctggaaacagc

SEQ ID NO: 60823 - DNA, 70 bp, Artificial Sequence
  Synthetic
gccaagcatttaggtgacactatagttacgtcaaactacctgtacgtttcagagctatgctggaaacagc

SEQ ID NO: 60824 - DNA, 70 bp, Artificial Sequence
  Synthetic
gccaagcatttaggtgacactatagttggctggaatcttctgaaggtttcagagctatgctggaaacagc

SEQ ID NO: 60825 - DNA, 70 bp, Artificial Sequence
  Synthetic
gccaagcatttaggtgacactatagctgtgaaggctcttgcgggagtttcagagctatgctggaaacagc

SEQ ID NO: 60826 - DNA, 70 bp, Artificial Sequence
  Synthetic
gccaagcatttaggtgacactatagggaagcccttcttttcatgggtttcagagctatgctggaaacagc

SEQ ID NO: 60827 - DNA, 70 bp, Artificial Sequence
  Synthetic
gccaagcatttaggtgacactatagttactctgacatttactaccgtttcagagctatgctggaaacagc

SEQ ID NO: 60828 - DNA, 70 bp, Artificial Sequence
  Synthetic
gccaagcatttaggtgacactatagaatgacatcccctactgagggtttcagagctatgctggaaacagc

SEQ ID NO: 60829 - DNA, 70 bp, Artificial Sequence
  Synthetic
gccaagcatttaggtgacactatagagcgtgtcacatgatgccgtgtttcagagctatgctggaaacagc

SEQ ID NO: 60830 - DNA, 70 bp, Artificial Sequence
  Synthetic
gccaagcatttaggtgacactatagcccattgcccctgccctcacgtttcagagctatgctggaaacagc

SEQ ID NO: 60831 - DNA, 70 bp, Artificial Sequence
  Synthetic
gccaagcatttaggtgacactataggggggcatcacagattcaccgtttcagagctatgctggaaacagc

SEQ ID NO: 60832 - DNA, 70 bp, Artificial Sequence
  Synthetic
gccaagcatttaggtgacactataggtctggtatgatgccaaagagtttcagagctatgctggaaacagc

SEQ ID NO: 60833 - DNA, 70 bp, Artificial Sequence
  Synthetic
gccaagcatttaggtgacactatagaacatgagtactgctttcatgtttcagagctatgctggaaacagc

SEQ ID NO: 60834 - DNA, 70 bp, Artificial Sequence
  Synthetic
gccaagcatttaggtgacactatagacatcatctcattggactaagtttcagagctatgctggaaacagc

SEQ ID NO: 60835 - DNA, 70 bp, Artificial Sequence
  Synthetic
gccaagcatttaggtgacactatagagcatgtcatcagatttgccgtttcagagctatgctggaaacagc

SEQ ID NO: 60836 - DNA, 70 bp, Artificial Sequence
  Synthetic
gccaagcatttaggtgacactatagcacaaagcagcccaaccaaagtttcagagctatgctggaaacagc

SEQ ID NO: 60837 - DNA, 70 bp, Artificial Sequence
  Synthetic
gccaagcatttaggtgacactataggcagcttttttgtcacacacgtttcagagctatgctggaaacagc

SEQ ID NO: 60838 - DNA, 70 bp, Artificial Sequence
  Synthetic
gccaagcatttaggtgacactatagtaatccagggaactcagtccgtttcagagctatgctggaaacagc

SEQ ID NO: 60839 - DNA, 70 bp, Artificial Sequence
  Synthetic
gccaagcatttaggtgacactatagagtgtgcggccggggtcagcgtttcagagctatgctggaaacagc

SEQ ID NO: 60840 - DNA, 70 bp, Artificial Sequence
  Synthetic
gccaagcatttaggtgacactatagttttgtttcttagaccactcgtttcagagctatgctggaaacagc

SEQ ID NO: 60841 - DNA, 70 bp, Artificial Sequence
  Synthetic
gccaagcatttaggtgacactatagaacccctttggccctgtatcgtttcagagctatgctggaaacagc

SEQ ID NO: 60842 - DNA, 70 bp, Artificial Sequence
  Synthetic
gccaagcatttaggtgacactatagccttggacaagggtggaagcgtttcagagctatgctggaaacagc

SEQ ID NO: 60843 - DNA, 70 bp, Artificial Sequence
  Synthetic
gccaagcatttaggtgacactatagcaagttcattcagccatcatgtttcagagctatgctggaaacagc

SEQ ID NO: 60844 - DNA, 70 bp, Artificial Sequence
  Synthetic
gccaagcatttaggtgacactatagaagtctgtggggcctaggccgtttcagagctatgctggaaacagc

SEQ ID NO: 60845 - DNA, 70 bp, Artificial Sequence
  Synthetic
gccaagcatttaggtgacactataggtggactcgtgagaaggagtgtttcagagctatgctggaaacagc

SEQ ID NO: 60846 - DNA, 70 bp, Artificial Sequence
  Synthetic
gccaagcatttaggtgacactatagcaccagagacaatgatcaaagtttcagagctatgctggaaacagc

SEQ ID NO: 60847 - DNA, 70 bp, Artificial Sequence
  Synthetic
gccaagcatttaggtgacactatagagtgtttggggacattgaaagtttcagagctatgctggaaacagc

SEQ ID NO: 60848 - DNA, 70 bp, Artificial Sequence
  Synthetic
gccaagcatttaggtgacactatagtctttgtgggtgaggctcaggtttcagagctatgctggaaacagc

SEQ ID NO: 60849 - DNA, 70 bp, Artificial Sequence
  Synthetic
gccaagcatttaggtgacactatagcagccgctcaattataatacgtttcagagctatgctggaaacagc

SEQ ID NO: 60850 - DNA, 70 bp, Artificial Sequence
  Synthetic
gccaagcatttaggtgacactataggatatctgaaaccaggtagagtttcagagctatgctggaaacagc

SEQ ID NO: 60851 - DNA, 70 bp, Artificial Sequence
  Synthetic
gccaagcatttaggtgacactatagcacttgccagagggtcgaatgtttcagagctatgctggaaacagc

SEQ ID NO: 60852 - DNA, 70 bp, Artificial Sequence
  Synthetic
gccaagcatttaggtgacactatagacagtatgccaaagatcagagtttcagagctatgctggaaacagc

SEQ ID NO: 60853 - DNA, 70 bp, Artificial Sequence
  Synthetic
gccaagcatttaggtgacactatagtggatgtcctaatttaactggtttcagagctatgctggaaacagc

SEQ ID NO: 60854 - DNA, 70 bp, Artificial Sequence
  Synthetic
gccaagcatttaggtgacactatagcatgtaccctgcagggggctgtttcagagctatgctggaaacagc

SEQ ID NO: 60855 - DNA, 70 bp, Artificial Sequence
  Synthetic
gccaagcatttaggtgacactatagtttcaccactctggatatacgtttcagagctatgctggaaacagc

SEQ ID NO: 60856 - DNA, 70 bp, Artificial Sequence
  Synthetic
gccaagcatttaggtgacactatagactgcgcagaaaggctgagcgtttcagagctatgctggaaacagc

SEQ ID NO: 60857 - DNA, 70 bp, Artificial Sequence
  Synthetic
gccaagcatttaggtgacactatagagtctaagactgtgtgagtcgtttcagagctatgctggaaacagc

SEQ ID NO: 60858 - DNA, 70 bp, Artificial Sequence
  Synthetic
gccaagcatttaggtgacactatagccagctctttacaatcacctgtttcagagctatgctggaaacagc

SEQ ID NO: 60859 - DNA, 70 bp, Artificial Sequence
  Synthetic
gccaagcatttaggtgacactatagccaggtgttcaaccagagtcgtttcagagctatgctggaaacagc

SEQ ID NO: 60860 - DNA, 70 bp, Artificial Sequence
  Synthetic
gccaagcatttaggtgacactatagtaaaagagcagagaaaacccgtttcagagctatgctggaaacagc

SEQ ID NO: 60861 - DNA, 70 bp, Artificial Sequence
  Synthetic
gccaagcatttaggtgacactatagttctgaacgctggggctcatgtttcagagctatgctggaaacagc

SEQ ID NO: 60862 - DNA, 70 bp, Artificial Sequence
  Synthetic
gccaagcatttaggtgacactataggggctttattctgggattatgtttcagagctatgctggaaacagc

SEQ ID NO: 60863 - DNA, 70 bp, Artificial Sequence
  Synthetic
gccaagcatttaggtgacactatagaaaacccttcaaggcttcaggtttcagagctatgctggaaacagc

SEQ ID NO: 60864 - DNA, 70 bp, Artificial Sequence
  Synthetic
gccaagcatttaggtgacactatagtatttgattctctctgtcaggtttcagagctatgctggaaacagc

SEQ ID NO: 60865 - DNA, 70 bp, Artificial Sequence
  Synthetic
gccaagcatttaggtgacactatagcccaaaagtcacttcatgtggtttcagagctatgctggaaacagc

SEQ ID NO: 60866 - DNA, 70 bp, Artificial Sequence
  Synthetic
gccaagcatttaggtgacactatagacagactaggctacctctgcgtttcagagctatgctggaaacagc

SEQ ID NO: 60867 - DNA, 70 bp, Artificial Sequence
  Synthetic
gccaagcatttaggtgacactatagtggctgcaagaaagaacattgtttcagagctatgctggaaacagc

SEQ ID NO: 60868 - DNA, 70 bp, Artificial Sequence
  Synthetic
gccaagcatttaggtgacactatagcttcacaaagcgacctctccgtttcagagctatgctggaaacagc

SEQ ID NO: 60869 - DNA, 70 bp, Artificial Sequence
  Synthetic
gccaagcatttaggtgacactataggaggggacaagcaggactgagtttcagagctatgctggaaacagc

SEQ ID NO: 60870 - DNA, 70 bp, Artificial Sequence
  Synthetic
gccaagcatttaggtgacactatagcggcccccaggaagcctagagtttcagagctatgctggaaacagc

SEQ ID NO: 60871 - DNA, 70 bp, Artificial Sequence
  Synthetic
gccaagcatttaggtgacactatagcctgagaagacagactgagcgtttcagagctatgctggaaacagc

SEQ ID NO: 60872 - DNA, 70 bp, Artificial Sequence
  Synthetic
gccaagcatttaggtgacactatagggaaagggcaagaatcagaggtttcagagctatgctggaaacagc

SEQ ID NO: 60873 - DNA, 70 bp, Artificial Sequence
  Synthetic
gccaagcatttaggtgacactatagggccatgctcgtgctcaagtgtttcagagctatgctggaaacagc

SEQ ID NO: 60874 - DNA, 70 bp, Artificial Sequence
  Synthetic
gccaagcatttaggtgacactatagttcctgccttggacatgaccgtttcagagctatgctggaaacagc

SEQ ID NO: 60875 - DNA, 70 bp, Artificial Sequence
  Synthetic
gccaagcatttaggtgacactatagtaccttgtgggccttatttggtttcagagctatgctggaaacagc

SEQ ID NO: 60876 - DNA, 70 bp, Artificial Sequence
  Synthetic
gccaagcatttaggtgacactatagcaaggatcaatgtagagcacgtttcagagctatgctggaaacagc

SEQ ID NO: 60877 - DNA, 70 bp, Artificial Sequence
  Synthetic
gccaagcatttaggtgacactatagaagtaagaagcaagaagaaggtttcagagctatgctggaaacagc

SEQ ID NO: 60878 - DNA, 70 bp, Artificial Sequence
  Synthetic
gccaagcatttaggtgacactatagtcttcacattgtggagctgggtttcagagctatgctggaaacagc

SEQ ID NO: 60879 - DNA, 70 bp, Artificial Sequence
  Synthetic
gccaagcatttaggtgacactatagctgccggtgccttcttgatcgtttcagagctatgctggaaacagc

SEQ ID NO: 60880 - DNA, 70 bp, Artificial Sequence
  Synthetic
gccaagcatttaggtgacactatagatgctcttctttcacaccaagtttcagagctatgctggaaacagc

SEQ ID NO: 60881 - DNA, 70 bp, Artificial Sequence
  Synthetic
gccaagcatttaggtgacactatagtcatctttcgctaatgcttggtttcagagctatgctggaaacagc

SEQ ID NO: 60882 - DNA, 70 bp, Artificial Sequence
  Synthetic
gccaagcatttaggtgacactatagatttcaagagtttcagtctcgtttcagagctatgctggaaacagc

SEQ ID NO: 60883 - DNA, 70 bp, Artificial Sequence
  Synthetic
gccaagcatttaggtgacactataggaggtggaatcagcgtcctcgtttcagagctatgctggaaacagc

SEQ ID NO: 60884 - DNA, 70 bp, Artificial Sequence
  Synthetic
gccaagcatttaggtgacactatagtaaatggtatcagctgactggtttcagagctatgctggaaacagc

SEQ ID NO: 60885 - DNA, 70 bp, Artificial Sequence
  Synthetic
gccaagcatttaggtgacactataggtggctctgctgggctcacagtttcagagctatgctggaaacagc

SEQ ID NO: 60886 - DNA, 70 bp, Artificial Sequence
  Synthetic
gccaagcatttaggtgacactatagtcccactcgataaagaaaaagtttcagagctatgctggaaacagc

SEQ ID NO: 60887 - DNA, 70 bp, Artificial Sequence
  Synthetic
gccaagcatttaggtgacactatagtgctctttttgctgcagtgggtttcagagctatgctggaaacagc

SEQ ID NO: 60888 - DNA, 70 bp, Artificial Sequence
  Synthetic
gccaagcatttaggtgacactatagatgcatgctgtttaattgtggtttcagagctatgctggaaacagc

SEQ ID NO: 60889 - DNA, 70 bp, Artificial Sequence
  Synthetic
gccaagcatttaggtgacactatagactggatggcccacacagttgtttcagagctatgctggaaacagc

SEQ ID NO: 60890 - DNA, 70 bp, Artificial Sequence
  Synthetic
gccaagcatttaggtgacactatagccaaagacaacaggcagtaggtttcagagctatgctggaaacagc

SEQ ID NO: 60891 - DNA, 70 bp, Artificial Sequence
  Synthetic
gccaagcatttaggtgacactatagcttgttcttggcatcaaacagtttcagagctatgctggaaacagc

SEQ ID NO: 60892 - DNA, 70 bp, Artificial Sequence
  Synthetic
gccaagcatttaggtgacactatagaaaaaggacctgggaactctgtttcagagctatgctggaaacagc

SEQ ID NO: 60893 - DNA, 70 bp, Artificial Sequence
  Synthetic
gccaagcatttaggtgacactatagactgggggggctcaggccccgtttcagagctatgctggaaacagc

SEQ ID NO: 60894 - DNA, 70 bp, Artificial Sequence
  Synthetic
gccaagcatttaggtgacactatagacccagtatatgcacagcaggtttcagagctatgctggaaacagc

SEQ ID NO: 60895 - DNA, 70 bp, Artificial Sequence
  Synthetic
gccaagcatttaggtgacactatagggcgggtcctcggtgctcaggtttcagagctatgctggaaacagc

SEQ ID NO: 60896 - DNA, 70 bp, Artificial Sequence
  Synthetic
gccaagcatttaggtgacactatagccctcgctttgcagataaaggtttcagagctatgctggaaacagc

SEQ ID NO: 60897 - DNA, 70 bp, Artificial Sequence
  Synthetic
gccaagcatttaggtgacactataggagatgggattgtgaaggtggtttcagagctatgctggaaacagc

SEQ ID NO: 60898 - DNA, 70 bp, Artificial Sequence
  Synthetic
gccaagcatttaggtgacactatagagtggagctctgccctagtggtttcagagctatgctggaaacagc

SEQ ID NO: 60899 - DNA, 70 bp, Artificial Sequence
  Synthetic
gccaagcatttaggtgacactatagtgctgtccctgcaggctcacgtttcagagctatgctggaaacagc

SEQ ID NO: 60900 - DNA, 70 bp, Artificial Sequence
  Synthetic
gccaagcatttaggtgacactatagccagaccactggacaggcttgtttcagagctatgctggaaacagc

SEQ ID NO: 60901 - DNA, 70 bp, Artificial Sequence
  Synthetic
gccaagcatttaggtgacactatagctgctgaccaaaaaggtagggtttcagagctatgctggaaacagc

SEQ ID NO: 60902 - DNA, 70 bp, Artificial Sequence
  Synthetic
gccaagcatttaggtgacactatagaggagccatatgagaatatcgtttcagagctatgctggaaacagc

SEQ ID NO: 60903 - DNA, 70 bp, Artificial Sequence
  Synthetic
gccaagcatttaggtgacactataggaccctgtactctgtcttaagtttcagagctatgctggaaacagc

SEQ ID NO: 60904 - DNA, 70 bp, Artificial Sequence
  Synthetic
gccaagcatttaggtgacactataggttggtcagaagtcactgctgtttcagagctatgctggaaacagc

SEQ ID NO: 60905 - DNA, 70 bp, Artificial Sequence
  Synthetic
gccaagcatttaggtgacactatagccagaaaggctgctatttgcgtttcagagctatgctggaaacagc

SEQ ID NO: 60906 - DNA, 70 bp, Artificial Sequence
  Synthetic
gccaagcatttaggtgacactatagaggccaggcttagggtagcagtttcagagctatgctggaaacagc

SEQ ID NO: 60907 - DNA, 70 bp, Artificial Sequence
  Synthetic
gccaagcatttaggtgacactatagtccagcagcgagagcttgtggtttcagagctatgctggaaacagc

SEQ ID NO: 60908 - DNA, 70 bp, Artificial Sequence
  Synthetic
gccaagcatttaggtgacactataggtctctctcattcatgactggtttcagagctatgctggaaacagc

SEQ ID NO: 60909 - DNA, 70 bp, Artificial Sequence
  Synthetic
gccaagcatttaggtgacactataggttttttccaggaagctcacgtttcagagctatgctggaaacagc

SEQ ID NO: 60910 - DNA, 70 bp, Artificial Sequence
  Synthetic
gccaagcatttaggtgacactatagtcatcctccgcactgagtgagtttcagagctatgctggaaacagc

SEQ ID NO: 60911 - DNA, 70 bp, Artificial Sequence
  Synthetic
gccaagcatttaggtgacactatagccaccggttaagacaaaattgtttcagagctatgctggaaacagc

SEQ ID NO: 60912 - DNA, 70 bp, Artificial Sequence
  Synthetic
gccaagcatttaggtgacactatagttacaaaccaccccttaaaggtttcagagctatgctggaaacagc

SEQ ID NO: 60913 - DNA, 70 bp, Artificial Sequence
  Synthetic
gccaagcatttaggtgacactataggctccatgcagggacatcacgtttcagagctatgctggaaacagc

SEQ ID NO: 60914 - DNA, 70 bp, Artificial Sequence
  Synthetic
gccaagcatttaggtgacactatagctgttcagatagcttttcaggtttcagagctatgctggaaacagc

SEQ ID NO: 60915 - DNA, 70 bp, Artificial Sequence
  Synthetic
gccaagcatttaggtgacactatagccggctgggaaggattcattgtttcagagctatgctggaaacagc

SEQ ID NO: 60916 - DNA, 70 bp, Artificial Sequence
  Synthetic
gccaagcatttaggtgacactataggtctcagaaatgtcagacccgtttcagagctatgctggaaacagc

SEQ ID NO: 60917 - DNA, 70 bp, Artificial Sequence
  Synthetic
gccaagcatttaggtgacactatagtaatccccatcaaaaacaacgtttcagagctatgctggaaacagc

SEQ ID NO: 60918 - DNA, 70 bp, Artificial Sequence
  Synthetic
gccaagcatttaggtgacactatagcaggaggttacgtcaagatggtttcagagctatgctggaaacagc

SEQ ID NO: 60919 - DNA, 70 bp, Artificial Sequence
  Synthetic
gccaagcatttaggtgacactatagaggtagaagagaactacgtcgtttcagagctatgctggaaacagc

SEQ ID NO: 60920 - DNA, 70 bp, Artificial Sequence
  Synthetic
gccaagcatttaggtgacactatagagtctcttaggcaaagatgtgtttcagagctatgctggaaacagc

SEQ ID NO: 60921 - DNA, 70 bp, Artificial Sequence
  Synthetic
gccaagcatttaggtgacactatagatcaggctcaggagaagttcgtttcagagctatgctggaaacagc

SEQ ID NO: 60922 - DNA, 70 bp, Artificial Sequence
  Synthetic
gccaagcatttaggtgacactataggcttatgcaaaactgtgttcgtttcagagctatgctggaaacagc

SEQ ID NO: 60923 - DNA, 70 bp, Artificial Sequence
  Synthetic
gccaagcatttaggtgacactatagttctgaggctttgcgcttaagtttcagagctatgctggaaacagc

SEQ ID NO: 60924 - DNA, 70 bp, Artificial Sequence
  Synthetic
gccaagcatttaggtgacactatagatgagcactatccacacgacgtttcagagctatgctggaaacagc

SEQ ID NO: 60925 - DNA, 70 bp, Artificial Sequence
  Synthetic
gccaagcatttaggtgacactataggcccaacactctggaagtgcgtttcagagctatgctggaaacagc

SEQ ID NO: 60926 - DNA, 70 bp, Artificial Sequence
  Synthetic
gccaagcatttaggtgacactatagcagccaggcctcggacgagggtttcagagctatgctggaaacagc

SEQ ID NO: 60927 - DNA, 70 bp, Artificial Sequence
  Synthetic
gccaagcatttaggtgacactatagtgtgtcgctctcgccgtcgggtttcagagctatgctggaaacagc

SEQ ID NO: 60928 - DNA, 70 bp, Artificial Sequence
  Synthetic
gccaagcatttaggtgacactatagttgttttccagaagggctttgtttcagagctatgctggaaacagc

SEQ ID NO: 60929 - DNA, 70 bp, Artificial Sequence
  Synthetic
gccaagcatttaggtgacactatagggaggcgcacacggagtgacgtttcagagctatgctggaaacagc

SEQ ID NO: 60930 - DNA, 70 bp, Artificial Sequence
  Synthetic
gccaagcatttaggtgacactatagggcttctggccagaggtcaagtttcagagctatgctggaaacagc

SEQ ID NO: 60931 - DNA, 70 bp, Artificial Sequence
  Synthetic
gccaagcatttaggtgacactatagaatcaaagattgggaactaggtttcagagctatgctggaaacagc

SEQ ID NO: 60932 - DNA, 70 bp, Artificial Sequence
  Synthetic
gccaagcatttaggtgacactatagccttcttcctgactcgctgagtttcagagctatgctggaaacagc

SEQ ID NO: 60933 - DNA, 70 bp, Artificial Sequence
  Synthetic
gccaagcatttaggtgacactatagagagactctagagcgagcccgtttcagagctatgctggaaacagc

SEQ ID NO: 60934 - DNA, 70 bp, Artificial Sequence
  Synthetic
gccaagcatttaggtgacactatagcacgaagctgaagtcattgtgtttcagagctatgctggaaacagc

SEQ ID NO: 60935 - DNA, 70 bp, Artificial Sequence
  Synthetic
gccaagcatttaggtgacactatagtaggaaataaagtgtgtctggtttcagagctatgctggaaacagc

SEQ ID NO: 60936 - DNA, 70 bp, Artificial Sequence
  Synthetic
gccaagcatttaggtgacactatagtctgctgtcattcctttcacgtttcagagctatgctggaaacagc

SEQ ID NO: 60937 - DNA, 70 bp, Artificial Sequence
  Synthetic
gccaagcatttaggtgacactataggggttccgttcgaggcacgtgtttcagagctatgctggaaacagc

SEQ ID NO: 60938 - DNA, 70 bp, Artificial Sequence
  Synthetic
gccaagcatttaggtgacactataggattcttcttcactcatcacgtttcagagctatgctggaaacagc

SEQ ID NO: 60939 - DNA, 70 bp, Artificial Sequence
  Synthetic
gccaagcatttaggtgacactatagtactcagatttgggccgacagtttcagagctatgctggaaacagc

SEQ ID NO: 60940 - DNA, 70 bp, Artificial Sequence
  Synthetic
gccaagcatttaggtgacactatagtgactctctatgtcatccacgtttcagagctatgctggaaacagc

SEQ ID NO: 60941 - DNA, 70 bp, Artificial Sequence
  Synthetic
gccaagcatttaggtgacactatagaagctggacagcgaggagtggtttcagagctatgctggaaacagc

SEQ ID NO: 60942 - DNA, 70 bp, Artificial Sequence
  Synthetic
gccaagcatttaggtgacactatagtgcactcacggtgccctactgtttcagagctatgctggaaacagc

SEQ ID NO: 60943 - DNA, 70 bp, Artificial Sequence
  Synthetic
gccaagcatttaggtgacactataggttcgagtcggtgccctgaggtttcagagctatgctggaaacagc

SEQ ID NO: 60944 - DNA, 70 bp, Artificial Sequence
  Synthetic
gccaagcatttaggtgacactatagcgagcgccacggctgctcatgtttcagagctatgctggaaacagc

SEQ ID NO: 60945 - DNA, 70 bp, Artificial Sequence
  Synthetic
gccaagcatttaggtgacactatagggggcggtcagctgttgtacgtttcagagctatgctggaaacagc

SEQ ID NO: 60946 - DNA, 70 bp, Artificial Sequence
  Synthetic
gccaagcatttaggtgacactatagcgctgtgggtgcggctcacagtttcagagctatgctggaaacagc

SEQ ID NO: 60947 - DNA, 70 bp, Artificial Sequence
  Synthetic
gccaagcatttaggtgacactatagcgtggaaaggcccgtatgaggtttcagagctatgctggaaacagc

SEQ ID NO: 60948 - DNA, 70 bp, Artificial Sequence
  Synthetic
gccaagcatttaggtgacactatagcaacaagtagaagcacttacgtttcagagctatgctggaaacagc

SEQ ID NO: 60949 - DNA, 70 bp, Artificial Sequence
  Synthetic
gccaagcatttaggtgacactatagcatcgtcttctgcaggttaggtttcagagctatgctggaaacagc

SEQ ID NO: 60950 - DNA, 70 bp, Artificial Sequence
  Synthetic
gccaagcatttaggtgacactatagtctccaagctgtgcagtcacgtttcagagctatgctggaaacagc

SEQ ID NO: 60951 - DNA, 70 bp, Artificial Sequence
  Synthetic
gccaagcatttaggtgacactatagggtcttcttctgcaggtcaagtttcagagctatgctggaaacagc

SEQ ID NO: 60952 - DNA, 70 bp, Artificial Sequence
  Synthetic
gccaagcatttaggtgacactatagccagtagttcatgccatcacgtttcagagctatgctggaaacagc

SEQ ID NO: 60953 - DNA, 70 bp, Artificial Sequence
  Synthetic
gccaagcatttaggtgacactatagaacggccttggtctttagaggtttcagagctatgctggaaacagc

SEQ ID NO: 60954 - DNA, 70 bp, Artificial Sequence
  Synthetic
gccaagcatttaggtgacactatagtctgcaatactgtcatttgagtttcagagctatgctggaaacagc

SEQ ID NO: 60955 - DNA, 70 bp, Artificial Sequence
  Synthetic
gccaagcatttaggtgacactatagtgctttcagtgttctgttgagtttcagagctatgctggaaacagc

SEQ ID NO: 60956 - DNA, 70 bp, Artificial Sequence
  Synthetic
gccaagcatttaggtgacactataggaaggaggactaagtgctgcgtttcagagctatgctggaaacagc

SEQ ID NO: 60957 - DNA, 70 bp, Artificial Sequence
  Synthetic
gccaagcatttaggtgacactataggcagacatcaaggacttctggtttcagagctatgctggaaacagc

SEQ ID NO: 60958 - DNA, 70 bp, Artificial Sequence
  Synthetic
gccaagcatttaggtgacactataggtatctcacgctaggtgagagtttcagagctatgctggaaacagc

SEQ ID NO: 60959 - DNA, 70 bp, Artificial Sequence
  Synthetic
gccaagcatttaggtgacactatagtggacgaacagcttagtcctgtttcagagctatgctggaaacagc

SEQ ID NO: 60960 - DNA, 70 bp, Artificial Sequence
  Synthetic
gccaagcatttaggtgacactatagcaagcagccacgacagcagtgtttcagagctatgctggaaacagc

SEQ ID NO: 60961 - DNA, 70 bp, Artificial Sequence
  Synthetic
gccaagcatttaggtgacactatagtgaaacacacatatcatacggtttcagagctatgctggaaacagc

SEQ ID NO: 60962 - DNA, 70 bp, Artificial Sequence
  Synthetic
gccaagcatttaggtgacactataggtgagattccaacgttgcaggtttcagagctatgctggaaacagc

SEQ ID NO: 60963 - DNA, 70 bp, Artificial Sequence
  Synthetic
gccaagcatttaggtgacactataggctaaatcaagtggtgagaagtttcagagctatgctggaaacagc

SEQ ID NO: 60964 - DNA, 70 bp, Artificial Sequence
  Synthetic
gccaagcatttaggtgacactatagtctcattttgtacttggttggtttcagagctatgctggaaacagc

SEQ ID NO: 60965 - DNA, 70 bp, Artificial Sequence
  Synthetic
gccaagcatttaggtgacactatagccctcagataggtcagccaggtttcagagctatgctggaaacagc

SEQ ID NO: 60966 - DNA, 70 bp, Artificial Sequence
  Synthetic
gccaagcatttaggtgacactatagaaacatcaacgggaagaaaagtttcagagctatgctggaaacagc

SEQ ID NO: 60967 - DNA, 70 bp, Artificial Sequence
  Synthetic
gccaagcatttaggtgacactatagaatcttcaaagcctgctcaggtttcagagctatgctggaaacagc

SEQ ID NO: 60968 - DNA, 70 bp, Artificial Sequence
  Synthetic
gccaagcatttaggtgacactatagattcaggagcaactgtgatcgtttcagagctatgctggaaacagc

SEQ ID NO: 60969 - DNA, 70 bp, Artificial Sequence
  Synthetic
gccaagcatttaggtgacactatagggttggaagaatgtggctctgtttcagagctatgctggaaacagc

SEQ ID NO: 60970 - DNA, 70 bp, Artificial Sequence
  Synthetic
gccaagcatttaggtgacactatagcagattttgctgcttctcccgtttcagagctatgctggaaacagc

SEQ ID NO: 60971 - DNA, 70 bp, Artificial Sequence
  Synthetic
gccaagcatttaggtgacactatagactggaggctctctccgtgagtttcagagctatgctggaaacagc

SEQ ID NO: 60972 - DNA, 70 bp, Artificial Sequence
  Synthetic
gccaagcatttaggtgacactataggtgccagggacaggaaagatgtttcagagctatgctggaaacagc

SEQ ID NO: 60973 - DNA, 70 bp, Artificial Sequence
  Synthetic
gccaagcatttaggtgacactatagacaaggtcagattcaagacggtttcagagctatgctggaaacagc

SEQ ID NO: 60974 - DNA, 70 bp, Artificial Sequence
  Synthetic
gccaagcatttaggtgacactatagcggctacaccaacatcatgcgtttcagagctatgctggaaacagc

SEQ ID NO: 60975 - DNA, 70 bp, Artificial Sequence
  Synthetic
gccaagcatttaggtgacactataggtgttgttcctgtgccgtgagtttcagagctatgctggaaacagc

SEQ ID NO: 60976 - DNA, 70 bp, Artificial Sequence
  Synthetic
gccaagcatttaggtgacactatagagttgatgtcacttaggtccgtttcagagctatgctggaaacagc

SEQ ID NO: 60977 - DNA, 70 bp, Artificial Sequence
  Synthetic
gccaagcatttaggtgacactataggcagagtctggggctcaggtgtttcagagctatgctggaaacagc

SEQ ID NO: 60978 - DNA, 70 bp, Artificial Sequence
  Synthetic
gccaagcatttaggtgacactataggggagggggctagcagccccgtttcagagctatgctggaaacagc

SEQ ID NO: 60979 - DNA, 70 bp, Artificial Sequence
  Synthetic
gccaagcatttaggtgacactataggatactttcggaagaggagcgtttcagagctatgctggaaacagc

SEQ ID NO: 60980 - DNA, 70 bp, Artificial Sequence
  Synthetic
gccaagcatttaggtgacactatagagcgattcctggaaccctgagtttcagagctatgctggaaacagc

SEQ ID NO: 60981 - DNA, 70 bp, Artificial Sequence
  Synthetic
gccaagcatttaggtgacactataggcggacctgcgctactttgagtttcagagctatgctggaaacagc

SEQ ID NO: 60982 - DNA, 70 bp, Artificial Sequence
  Synthetic
gccaagcatttaggtgacactatagacagtgactccctgcagtaggtttcagagctatgctggaaacagc

SEQ ID NO: 60983 - DNA, 70 bp, Artificial Sequence
  Synthetic
gccaagcatttaggtgacactatagagtgactccctggagtagtcgtttcagagctatgctggaaacagc

SEQ ID NO: 60984 - DNA, 70 bp, Artificial Sequence
  Synthetic
gccaagcatttaggtgacactatagggacagtctcttcttagaatgtttcagagctatgctggaaacagc

SEQ ID NO: 60985 - DNA, 70 bp, Artificial Sequence
  Synthetic
gccaagcatttaggtgacactatagtaccactcccttaaagactggtttcagagctatgctggaaacagc

SEQ ID NO: 60986 - DNA, 70 bp, Artificial Sequence
  Synthetic
gccaagcatttaggtgacactatagctccagaaggcttcacctatgtttcagagctatgctggaaacagc

SEQ ID NO: 60987 - DNA, 70 bp, Artificial Sequence
  Synthetic
gccaagcatttaggtgacactatagcccagggtccccagactcatgtttcagagctatgctggaaacagc

SEQ ID NO: 60988 - DNA, 70 bp, Artificial Sequence
  Synthetic
gccaagcatttaggtgacactatagaggagctcataggtatgttcgtttcagagctatgctggaaacagc

SEQ ID NO: 60989 - DNA, 70 bp, Artificial Sequence
  Synthetic
gccaagcatttaggtgacactataggcccaggttaaactacacacgtttcagagctatgctggaaacagc

SEQ ID NO: 60990 - DNA, 70 bp, Artificial Sequence
  Synthetic
gccaagcatttaggtgacactatagtcaaggtagtcagtcacactgtttcagagctatgctggaaacagc

SEQ ID NO: 60991 - DNA, 70 bp, Artificial Sequence
  Synthetic
gccaagcatttaggtgacactatagttcataatgacacctgcatggtttcagagctatgctggaaacagc

SEQ ID NO: 60992 - DNA, 70 bp, Artificial Sequence
  Synthetic
gccaagcatttaggtgacactataggaggagaaggaagagttatggtttcagagctatgctggaaacagc

SEQ ID NO: 60993 - DNA, 70 bp, Artificial Sequence
  Synthetic
gccaagcatttaggtgacactatagggcacaggagtcagggcccagtttcagagctatgctggaaacagc

SEQ ID NO: 60994 - DNA, 70 bp, Artificial Sequence
  Synthetic
gccaagcatttaggtgacactatagttgagaacatgactccaatagtttcagagctatgctggaaacagc

SEQ ID NO: 60995 - DNA, 70 bp, Artificial Sequence
  Synthetic
gccaagcatttaggtgacactatagtcaactctgacaatacttctgtttcagagctatgctggaaacagc

SEQ ID NO: 60996 - DNA, 70 bp, Artificial Sequence
  Synthetic
gccaagcatttaggtgacactataggaagaggggactcagcaacggtttcagagctatgctggaaacagc

SEQ ID NO: 60997 - DNA, 70 bp, Artificial Sequence
  Synthetic
gccaagcatttaggtgacactatagcccaccctgcaaaaaagcctgtttcagagctatgctggaaacagc

SEQ ID NO: 60998 - DNA, 70 bp, Artificial Sequence
  Synthetic
gccaagcatttaggtgacactatagcctatgagaggctttatcttgtttcagagctatgctggaaacagc

SEQ ID NO: 60999 - DNA, 70 bp, Artificial Sequence
  Synthetic
gccaagcatttaggtgacactatagggtgtgggcttctagcacccgtttcagagctatgctggaaacagc

SEQ ID NO: 61000 - DNA, 70 bp, Artificial Sequence
  Synthetic
gccaagcatttaggtgacactatagatcccaacaagctgtgcaccgtttcagagctatgctggaaacagc

SEQ ID NO: 61001 - DNA, 70 bp, Artificial Sequence
  Synthetic
gccaagcatttaggtgacactatagaaacctcagaggctctaggggtttcagagctatgctggaaacagc

SEQ ID NO: 61002 - DNA, 70 bp, Artificial Sequence
  Synthetic
gccaagcatttaggtgacactatagaaagctgaaactgaggtcacgtttcagagctatgctggaaacagc

SEQ ID NO: 61003 - DNA, 70 bp, Artificial Sequence
  Synthetic
gccaagcatttaggtgacactatagccagtacatgaactatgcttgtttcagagctatgctggaaacagc

SEQ ID NO: 61004 - DNA, 70 bp, Artificial Sequence
  Synthetic
gccaagcatttaggtgacactatagatgaacgtggccgggtaggtgtttcagagctatgctggaaacagc

SEQ ID NO: 61005 - DNA, 70 bp, Artificial Sequence
  Synthetic
gccaagcatttaggtgacactatagtagtgcccgaagttgctgctgtttcagagctatgctggaaacagc

SEQ ID NO: 61006 - DNA, 70 bp, Artificial Sequence
  Synthetic
gccaagcatttaggtgacactatagcctccaagggcacagacctggtttcagagctatgctggaaacagc

SEQ ID NO: 61007 - DNA, 70 bp, Artificial Sequence
  Synthetic
gccaagcatttaggtgacactataggaggctccctggggcctagggtttcagagctatgctggaaacagc

SEQ ID NO: 61008 - DNA, 70 bp, Artificial Sequence
  Synthetic
gccaagcatttaggtgacactatagccaggctcgggagagggcaggtttcagagctatgctggaaacagc

SEQ ID NO: 61009 - DNA, 70 bp, Artificial Sequence
  Synthetic
gccaagcatttaggtgacactatagtcccaacatcctctgctcctgtttcagagctatgctggaaacagc

SEQ ID NO: 61010 - DNA, 70 bp, Artificial Sequence
  Synthetic
gccaagcatttaggtgacactatagagctgctgctctcaccctgagtttcagagctatgctggaaacagc

SEQ ID NO: 61011 - DNA, 70 bp, Artificial Sequence
  Synthetic
gccaagcatttaggtgacactatagatcatgttacagaactcttcgtttcagagctatgctggaaacagc

SEQ ID NO: 61012 - DNA, 70 bp, Artificial Sequence
  Synthetic
gccaagcatttaggtgacactatagactgtactaaagttggttgcgtttcagagctatgctggaaacagc

SEQ ID NO: 61013 - DNA, 70 bp, Artificial Sequence
  Synthetic
gccaagcatttaggtgacactatagtggttgaatgctcaatttgagtttcagagctatgctggaaacagc

SEQ ID NO: 61014 - DNA, 70 bp, Artificial Sequence
  Synthetic
gccaagcatttaggtgacactatagcccactgctacagcaaatttgtttcagagctatgctggaaacagc

SEQ ID NO: 61015 - DNA, 70 bp, Artificial Sequence
  Synthetic
gccaagcatttaggtgacactatagccccaaacctgaggatcacagtttcagagctatgctggaaacagc

SEQ ID NO: 61016 - DNA, 70 bp, Artificial Sequence
  Synthetic
gccaagcatttaggtgacactatagggagtgagggtgtcagggtggtttcagagctatgctggaaacagc

SEQ ID NO: 61017 - DNA, 70 bp, Artificial Sequence
  Synthetic
gccaagcatttaggtgacactatagtcaagagagatatcaacagagtttcagagctatgctggaaacagc

SEQ ID NO: 61018 - DNA, 70 bp, Artificial Sequence
  Synthetic
gccaagcatttaggtgacactatagagttatcttgctgtcaaaccgtttcagagctatgctggaaacagc

SEQ ID NO: 61019 - DNA, 70 bp, Artificial Sequence
  Synthetic
gccaagcatttaggtgacactatagagccccgctcccgaccttctgtttcagagctatgctggaaacagc

SEQ ID NO: 61020 - DNA, 70 bp, Artificial Sequence
  Synthetic
gccaagcatttaggtgacactatagatttcacatgaagctaaggagtttcagagctatgctggaaacagc

SEQ ID NO: 61021 - DNA, 70 bp, Artificial Sequence
  Synthetic
gccaagcatttaggtgacactatagtttccatcaagcttttcagtgtttcagagctatgctggaaacagc

SEQ ID NO: 61022 - DNA, 70 bp, Artificial Sequence
  Synthetic
gccaagcatttaggtgacactatagctgaatgcatgatggaaatggtttcagagctatgctggaaacagc

SEQ ID NO: 61023 - DNA, 70 bp, Artificial Sequence
  Synthetic
gccaagcatttaggtgacactatagagggcctctgtgggggctacgtttcagagctatgctggaaacagc

SEQ ID NO: 61024 - DNA, 70 bp, Artificial Sequence
  Synthetic
gccaagcatttaggtgacactataggacaacatgcgaccgtgaccgtttcagagctatgctggaaacagc

SEQ ID NO: 61025 - DNA, 70 bp, Artificial Sequence
  Synthetic
gccaagcatttaggtgacactatagtcctccctggggaccctcaggtttcagagctatgctggaaacagc

SEQ ID NO: 61026 - DNA, 70 bp, Artificial Sequence
  Synthetic
gccaagcatttaggtgacactatagcctgagaccaccatgctgtggtttcagagctatgctggaaacagc

SEQ ID NO: 61027 - DNA, 70 bp, Artificial Sequence
  Synthetic
gccaagcatttaggtgacactataggatttcaggtttaggtccaggtttcagagctatgctggaaacagc

SEQ ID NO: 61028 - DNA, 70 bp, Artificial Sequence
  Synthetic
gccaagcatttaggtgacactatagggacccacccccgggcctaggtttcagagctatgctggaaacagc

SEQ ID NO: 61029 - DNA, 70 bp, Artificial Sequence
  Synthetic
gccaagcatttaggtgacactatagaaatcaaagttgtagacctcgtttcagagctatgctggaaacagc

SEQ ID NO: 61030 - DNA, 70 bp, Artificial Sequence
  Synthetic
gccaagcatttaggtgacactatagcgcgcctgtcaaggtttcatgtttcagagctatgctggaaacagc

SEQ ID NO: 61031 - DNA, 70 bp, Artificial Sequence
  Synthetic
gccaagcatttaggtgacactatagccaaccctcaagctctcaaggtttcagagctatgctggaaacagc

SEQ ID NO: 61032 - DNA, 70 bp, Artificial Sequence
  Synthetic
gccaagcatttaggtgacactatagcctggcaggagcattcacaggtttcagagctatgctggaaacagc

SEQ ID NO: 61033 - DNA, 70 bp, Artificial Sequence
  Synthetic
gccaagcatttaggtgacactatagcagtgggatgggggcatcaggtttcagagctatgctggaaacagc

SEQ ID NO: 61034 - DNA, 70 bp, Artificial Sequence
  Synthetic
gccaagcatttaggtgacactatagcgaccttatctcgctcctccgtttcagagctatgctggaaacagc

SEQ ID NO: 61035 - DNA, 70 bp, Artificial Sequence
  Synthetic
gccaagcatttaggtgacactataggagaacacgcagctctgaacgtttcagagctatgctggaaacagc

SEQ ID NO: 61036 - DNA, 70 bp, Artificial Sequence
  Synthetic
gccaagcatttaggtgacactataggagtttcatactactgttgcgtttcagagctatgctggaaacagc

SEQ ID NO: 61037 - DNA, 70 bp, Artificial Sequence
  Synthetic
gccaagcatttaggtgacactatagtgctgcttcagtttgcatttgtttcagagctatgctggaaacagc

SEQ ID NO: 61038 - DNA, 70 bp, Artificial Sequence
  Synthetic
gccaagcatttaggtgacactatagatctccctccaggactaggcgtttcagagctatgctggaaacagc

SEQ ID NO: 61039 - DNA, 70 bp, Artificial Sequence
  Synthetic
gccaagcatttaggtgacactatagtccgcatccagcgctcctgagtttcagagctatgctggaaacagc

SEQ ID NO: 61040 - DNA, 70 bp, Artificial Sequence
  Synthetic
gccaagcatttaggtgacactataggagggggatgagtcctgagggtttcagagctatgctggaaacagc

SEQ ID NO: 61041 - DNA, 70 bp, Artificial Sequence
  Synthetic
gccaagcatttaggtgacactatagatgctgcccttagtcactgtgtttcagagctatgctggaaacagc

SEQ ID NO: 61042 - DNA, 70 bp, Artificial Sequence
  Synthetic
gccaagcatttaggtgacactatagcgaggctggggtacaactaggtttcagagctatgctggaaacagc

SEQ ID NO: 61043 - DNA, 70 bp, Artificial Sequence
  Synthetic
gccaagcatttaggtgacactatagaccaggagaaatgcaacaaggtttcagagctatgctggaaacagc

SEQ ID NO: 61044 - DNA, 70 bp, Artificial Sequence
  Synthetic
gccaagcatttaggtgacactatagtctggtttatcatcactgctgtttcagagctatgctggaaacagc

SEQ ID NO: 61045 - DNA, 70 bp, Artificial Sequence
  Synthetic
gccaagcatttaggtgacactatagtcttttgctgtttcagatacgtttcagagctatgctggaaacagc

SEQ ID NO: 61046 - DNA, 70 bp, Artificial Sequence
  Synthetic
gccaagcatttaggtgacactatagtggggcgggctcctcagcgagtttcagagctatgctggaaacagc

SEQ ID NO: 61047 - DNA, 70 bp, Artificial Sequence
  Synthetic
gccaagcatttaggtgacactatagctcaaaagctggaggagatcgtttcagagctatgctggaaacagc

SEQ ID NO: 61048 - DNA, 70 bp, Artificial Sequence
  Synthetic
gccaagcatttaggtgacactatagttcccaccactgacggtcaggtttcagagctatgctggaaacagc

SEQ ID NO: 61049 - DNA, 70 bp, Artificial Sequence
  Synthetic
gccaagcatttaggtgacactatagaggaaagtagtgaggagaatgtttcagagctatgctggaaacagc

SEQ ID NO: 61050 - DNA, 70 bp, Artificial Sequence
  Synthetic
gccaagcatttaggtgacactatagaacgatgaaactggagaatggtttcagagctatgctggaaacagc

SEQ ID NO: 61051 - DNA, 70 bp, Artificial Sequence
  Synthetic
gccaagcatttaggtgacactataggaagctgctgtggtgctgacgtttcagagctatgctggaaacagc

SEQ ID NO: 61052 - DNA, 70 bp, Artificial Sequence
  Synthetic
gccaagcatttaggtgacactataggattcagcagaagatcctgagtttcagagctatgctggaaacagc

SEQ ID NO: 61053 - DNA, 70 bp, Artificial Sequence
  Synthetic
gccaagcatttaggtgacactatagtgagtcaggaaagaagctgagtttcagagctatgctggaaacagc

SEQ ID NO: 61054 - DNA, 70 bp, Artificial Sequence
  Synthetic
gccaagcatttaggtgacactatagcaagtagtgctatcaagtgtgtttcagagctatgctggaaacagc

SEQ ID NO: 61055 - DNA, 70 bp, Artificial Sequence
  Synthetic
gccaagcatttaggtgacactatagacataaacaaacagtgaagcgtttcagagctatgctggaaacagc

SEQ ID NO: 61056 - DNA, 70 bp, Artificial Sequence
  Synthetic
gccaagcatttaggtgacactatagccatagtgcccatggaggttgtttcagagctatgctggaaacagc

SEQ ID NO: 61057 - DNA, 70 bp, Artificial Sequence
  Synthetic
gccaagcatttaggtgacactataggcatgatccccctagaagtggtttcagagctatgctggaaacagc

SEQ ID NO: 61058 - DNA, 70 bp, Artificial Sequence
  Synthetic
gccaagcatttaggtgacactatagaacgcctgccgcctgctctggtttcagagctatgctggaaacagc

SEQ ID NO: 61059 - DNA, 70 bp, Artificial Sequence
  Synthetic
gccaagcatttaggtgacactatagtgcgtttggcagggctgagggtttcagagctatgctggaaacagc

SEQ ID NO: 61060 - DNA, 70 bp, Artificial Sequence
  Synthetic
gccaagcatttaggtgacactatagttcatcatgttatacgttccgtttcagagctatgctggaaacagc

SEQ ID NO: 61061 - DNA, 70 bp, Artificial Sequence
  Synthetic
gccaagcatttaggtgacactataggccccattcttggttaggttgtttcagagctatgctggaaacagc

SEQ ID NO: 61062 - DNA, 70 bp, Artificial Sequence
  Synthetic
gccaagcatttaggtgacactatagcctgagtctgccgtggcctggtttcagagctatgctggaaacagc

SEQ ID NO: 61063 - DNA, 70 bp, Artificial Sequence
  Synthetic
gccaagcatttaggtgacactatagagtctctttacttcccagttgtttcagagctatgctggaaacagc

SEQ ID NO: 61064 - DNA, 70 bp, Artificial Sequence
  Synthetic
gccaagcatttaggtgacactatagtttgatagcttcaatccactgtttcagagctatgctggaaacagc

SEQ ID NO: 61065 - DNA, 70 bp, Artificial Sequence
  Synthetic
gccaagcatttaggtgacactatagacgcaaacgtgccttcttaggtttcagagctatgctggaaacagc

SEQ ID NO: 61066 - DNA, 70 bp, Artificial Sequence
  Synthetic
gccaagcatttaggtgacactatagcagagcttgttcagtcacttgtttcagagctatgctggaaacagc

SEQ ID NO: 61067 - DNA, 70 bp, Artificial Sequence
  Synthetic
gccaagcatttaggtgacactatagcttccggtcagtgacgtgtggtttcagagctatgctggaaacagc

SEQ ID NO: 61068 - DNA, 70 bp, Artificial Sequence
  Synthetic
gccaagcatttaggtgacactatagtacggacctctgatgtgtgagtttcagagctatgctggaaacagc

SEQ ID NO: 61069 - DNA, 70 bp, Artificial Sequence
  Synthetic
gccaagcatttaggtgacactatagtcagtttcttcaggaagagagtttcagagctatgctggaaacagc

SEQ ID NO: 61070 - DNA, 70 bp, Artificial Sequence
  Synthetic
gccaagcatttaggtgacactatagctcccaagccctggctactggtttcagagctatgctggaaacagc

SEQ ID NO: 61071 - DNA, 70 bp, Artificial Sequence
  Synthetic
gccaagcatttaggtgacactatagcttttgggcggattagaagcgtttcagagctatgctggaaacagc

SEQ ID NO: 61072 - DNA, 70 bp, Artificial Sequence
  Synthetic
gccaagcatttaggtgacactatagactcagccgcagctcacagagtttcagagctatgctggaaacagc

SEQ ID NO: 61073 - DNA, 70 bp, Artificial Sequence
  Synthetic
gccaagcatttaggtgacactatagtatgcttcttcccagccagtgtttcagagctatgctggaaacagc

SEQ ID NO: 61074 - DNA, 70 bp, Artificial Sequence
  Synthetic
gccaagcatttaggtgacactatagcgacagcagctataccatgcgtttcagagctatgctggaaacagc

SEQ ID NO: 61075 - DNA, 70 bp, Artificial Sequence
  Synthetic
gccaagcatttaggtgacactatagcttggctcagtatgttaggagtttcagagctatgctggaaacagc

SEQ ID NO: 61076 - DNA, 70 bp, Artificial Sequence
  Synthetic
gccaagcatttaggtgacactatagttctttgcatgctgggtcacgtttcagagctatgctggaaacagc

SEQ ID NO: 61077 - DNA, 70 bp, Artificial Sequence
  Synthetic
gccaagcatttaggtgacactatagaatctgatgaggtggtatgagtttcagagctatgctggaaacagc

SEQ ID NO: 61078 - DNA, 70 bp, Artificial Sequence
  Synthetic
gccaagcatttaggtgacactataggctgggtcatcatgtcctgcgtttcagagctatgctggaaacagc

SEQ ID NO: 61079 - DNA, 70 bp, Artificial Sequence
  Synthetic
gccaagcatttaggtgacactatagggtagttcgaggggtttttggtttcagagctatgctggaaacagc

SEQ ID NO: 61080 - DNA, 70 bp, Artificial Sequence
  Synthetic
gccaagcatttaggtgacactatagtggtgtcaagtgttttctgtgtttcagagctatgctggaaacagc

SEQ ID NO: 61081 - DNA, 70 bp, Artificial Sequence
  Synthetic
gccaagcatttaggtgacactatagtgtaggaatgtgggtgtagagtttcagagctatgctggaaacagc

SEQ ID NO: 61082 - DNA, 70 bp, Artificial Sequence
  Synthetic
gccaagcatttaggtgacactatagtcccagggctcagaaccagcgtttcagagctatgctggaaacagc

SEQ ID NO: 61083 - DNA, 70 bp, Artificial Sequence
  Synthetic
gccaagcatttaggtgacactatagcagccacgggcatggccttagtttcagagctatgctggaaacagc

SEQ ID NO: 61084 - DNA, 70 bp, Artificial Sequence
  Synthetic
gccaagcatttaggtgacactatagctctattttgggtcttctaggtttcagagctatgctggaaacagc

SEQ ID NO: 61085 - DNA, 70 bp, Artificial Sequence
  Synthetic
gccaagcatttaggtgacactatagctcccggggtggaaagtgatgtttcagagctatgctggaaacagc

SEQ ID NO: 61086 - DNA, 70 bp, Artificial Sequence
  Synthetic
gccaagcatttaggtgacactatagtgcaggccgggggtcagctggtttcagagctatgctggaaacagc

SEQ ID NO: 61087 - DNA, 70 bp, Artificial Sequence
  Synthetic
gccaagcatttaggtgacactataggatgatgatagcagtgactagtttcagagctatgctggaaacagc

SEQ ID NO: 61088 - DNA, 70 bp, Artificial Sequence
  Synthetic
gccaagcatttaggtgacactatagagttcaagcagctttgcttagtttcagagctatgctggaaacagc

SEQ ID NO: 61089 - DNA, 70 bp, Artificial Sequence
  Synthetic
gccaagcatttaggtgacactataggtggagctctcagaaacatcgtttcagagctatgctggaaacagc

SEQ ID NO: 61090 - DNA, 70 bp, Artificial Sequence
  Synthetic
gccaagcatttaggtgacactatagctcatgtcctggctcacatggtttcagagctatgctggaaacagc

SEQ ID NO: 61091 - DNA, 70 bp, Artificial Sequence
  Synthetic
gccaagcatttaggtgacactatagtgaggcctgcgttcagtgtcgtttcagagctatgctggaaacagc

SEQ ID NO: 61092 - DNA, 70 bp, Artificial Sequence
  Synthetic
gccaagcatttaggtgacactatagttccaggccttgaactctgtgtttcagagctatgctggaaacagc

SEQ ID NO: 61093 - DNA, 70 bp, Artificial Sequence
  Synthetic
gccaagcatttaggtgacactatagggccctgggtaggggcctgggtttcagagctatgctggaaacagc

SEQ ID NO: 61094 - DNA, 70 bp, Artificial Sequence
  Synthetic
gccaagcatttaggtgacactatagaccctgacagtcatcaggccgtttcagagctatgctggaaacagc

SEQ ID NO: 61095 - DNA, 70 bp, Artificial Sequence
  Synthetic
gccaagcatttaggtgacactatagtgagcgtggagttaagcagcgtttcagagctatgctggaaacagc

SEQ ID NO: 61096 - DNA, 70 bp, Artificial Sequence
  Synthetic
gccaagcatttaggtgacactatagggggccccacatcattcagcgtttcagagctatgctggaaacagc

SEQ ID NO: 61097 - DNA, 70 bp, Artificial Sequence
  Synthetic
gccaagcatttaggtgacactatagcgcagaatcctctgaaatttgtttcagagctatgctggaaacagc

SEQ ID NO: 61098 - DNA, 70 bp, Artificial Sequence
  Synthetic
gccaagcatttaggtgacactatagagaaatattcacagcaacgtgtttcagagctatgctggaaacagc

SEQ ID NO: 61099 - DNA, 70 bp, Artificial Sequence
  Synthetic
gccaagcatttaggtgacactataggctccccagctttcagagtagtttcagagctatgctggaaacagc

SEQ ID NO: 61100 - DNA, 70 bp, Artificial Sequence
  Synthetic
gccaagcatttaggtgacactatagtggctgcttggggcagctgcgtttcagagctatgctggaaacagc

SEQ ID NO: 61101 - DNA, 70 bp, Artificial Sequence
  Synthetic
gccaagcatttaggtgacactatagcccggtgctatctcgtccccgtttcagagctatgctggaaacagc

SEQ ID NO: 61102 - DNA, 70 bp, Artificial Sequence
  Synthetic
gccaagcatttaggtgacactataggttccagctgagtggcttgcgtttcagagctatgctggaaacagc

SEQ ID NO: 61103 - DNA, 70 bp, Artificial Sequence
  Synthetic
gccaagcatttaggtgacactatagagcctaaatcaggaaccagcgtttcagagctatgctggaaacagc

SEQ ID NO: 61104 - DNA, 70 bp, Artificial Sequence
  Synthetic
gccaagcatttaggtgacactatagaggcgaaaatgttctgttccgtttcagagctatgctggaaacagc

SEQ ID NO: 61105 - DNA, 70 bp, Artificial Sequence
  Synthetic
gccaagcatttaggtgacactatagtcccgagacccctggtgctggtttcagagctatgctggaaacagc

SEQ ID NO: 61106 - DNA, 70 bp, Artificial Sequence
  Synthetic
gccaagcatttaggtgacactatagtcggctggagtcaggtgttcgtttcagagctatgctggaaacagc

SEQ ID NO: 61107 - DNA, 70 bp, Artificial Sequence
  Synthetic
gccaagcatttaggtgacactatagggcttgtgcagtggatctgagtttcagagctatgctggaaacagc

SEQ ID NO: 61108 - DNA, 70 bp, Artificial Sequence
  Synthetic
gccaagcatttaggtgacactatagaccggaagagcctgatgtgagtttcagagctatgctggaaacagc

SEQ ID NO: 61109 - DNA, 70 bp, Artificial Sequence
  Synthetic
gccaagcatttaggtgacactatagtacaggagaagtgcaccctagtttcagagctatgctggaaacagc

SEQ ID NO: 61110 - DNA, 70 bp, Artificial Sequence
  Synthetic
gccaagcatttaggtgacactatagctaatgatggtgctggttgtgtttcagagctatgctggaaacagc

SEQ ID NO: 61111 - DNA, 70 bp, Artificial Sequence
  Synthetic
gccaagcatttaggtgacactatagctctcacagaagccacaggagtttcagagctatgctggaaacagc

SEQ ID NO: 61112 - DNA, 70 bp, Artificial Sequence
  Synthetic
gccaagcatttaggtgacactataggtctggggtgcgttactcccgtttcagagctatgctggaaacagc

SEQ ID NO: 61113 - DNA, 70 bp, Artificial Sequence
  Synthetic
gccaagcatttaggtgacactatagcagcacacttctcttctaaagtttcagagctatgctggaaacagc

SEQ ID NO: 61114 - DNA, 70 bp, Artificial Sequence
  Synthetic
gccaagcatttaggtgacactatagccacttctccccacagacctgtttcagagctatgctggaaacagc

SEQ ID NO: 61115 - DNA, 70 bp, Artificial Sequence
  Synthetic
gccaagcatttaggtgacactatagggaagtcctccataatcattgtttcagagctatgctggaaacagc

SEQ ID NO: 61116 - DNA, 70 bp, Artificial Sequence
  Synthetic
gccaagcatttaggtgacactataggaatctactctgttcctttcgtttcagagctatgctggaaacagc

SEQ ID NO: 61117 - DNA, 70 bp, Artificial Sequence
  Synthetic
gccaagcatttaggtgacactatagctcagctcttcttgcgcagcgtttcagagctatgctggaaacagc

SEQ ID NO: 61118 - DNA, 70 bp, Artificial Sequence
  Synthetic
gccaagcatttaggtgacactataggagttttatgctcagatcgcgtttcagagctatgctggaaacagc

SEQ ID NO: 61119 - DNA, 70 bp, Artificial Sequence
  Synthetic
gccaagcatttaggtgacactatagcccggaggagaagaagtagggtttcagagctatgctggaaacagc

SEQ ID NO: 61120 - DNA, 70 bp, Artificial Sequence
  Synthetic
gccaagcatttaggtgacactatagctacagctactgcccgccaggtttcagagctatgctggaaacagc

SEQ ID NO: 61121 - DNA, 70 bp, Artificial Sequence
  Synthetic
gccaagcatttaggtgacactatagcatgggtcagaagtccagctgtttcagagctatgctggaaacagc

SEQ ID NO: 61122 - DNA, 70 bp, Artificial Sequence
  Synthetic
gccaagcatttaggtgacactatagaggggagggcagctattagggtttcagagctatgctggaaacagc

SEQ ID NO: 61123 - DNA, 70 bp, Artificial Sequence
  Synthetic
gccaagcatttaggtgacactatagatctttgtaagagcatgttcgtttcagagctatgctggaaacagc

SEQ ID NO: 61124 - DNA, 70 bp, Artificial Sequence
  Synthetic
gccaagcatttaggtgacactatagtcagggcttgggtcctaggcgtttcagagctatgctggaaacagc

SEQ ID NO: 61125 - DNA, 70 bp, Artificial Sequence
  Synthetic
gccaagcatttaggtgacactatagcaccaaatggtcaaacaactgtttcagagctatgctggaaacagc

SEQ ID NO: 61126 - DNA, 70 bp, Artificial Sequence
  Synthetic
gccaagcatttaggtgacactatagactagatactctgcagcatggtttcagagctatgctggaaacagc

SEQ ID NO: 61127 - DNA, 70 bp, Artificial Sequence
  Synthetic
gccaagcatttaggtgacactataggccaccagtcagatggctgggtttcagagctatgctggaaacagc

SEQ ID NO: 61128 - DNA, 70 bp, Artificial Sequence
  Synthetic
gccaagcatttaggtgacactatagttcttcctctatcaaccaaagtttcagagctatgctggaaacagc

SEQ ID NO: 61129 - DNA, 70 bp, Artificial Sequence
  Synthetic
gccaagcatttaggtgacactatagctccttcgtcgatccctaatgtttcagagctatgctggaaacagc

SEQ ID NO: 61130 - DNA, 70 bp, Artificial Sequence
  Synthetic
gccaagcatttaggtgacactatagagactcacacatttgcatgagtttcagagctatgctggaaacagc

SEQ ID NO: 61131 - DNA, 70 bp, Artificial Sequence
  Synthetic
gccaagcatttaggtgacactataggcagagtggttgagtgtcaggtttcagagctatgctggaaacagc

SEQ ID NO: 61132 - DNA, 70 bp, Artificial Sequence
  Synthetic
gccaagcatttaggtgacactatagttctacgggggatcagaactgtttcagagctatgctggaaacagc

SEQ ID NO: 61133 - DNA, 70 bp, Artificial Sequence
  Synthetic
gccaagcatttaggtgacactatagtgagggaagttcgcctacacgtttcagagctatgctggaaacagc

SEQ ID NO: 61134 - DNA, 70 bp, Artificial Sequence
  Synthetic
gccaagcatttaggtgacactatagggccccgctggaggtggcacgtttcagagctatgctggaaacagc

SEQ ID NO: 61135 - DNA, 70 bp, Artificial Sequence
  Synthetic
gccaagcatttaggtgacactatagtggtgaattcattctgttctgtttcagagctatgctggaaacagc

SEQ ID NO: 61136 - DNA, 70 bp, Artificial Sequence
  Synthetic
gccaagcatttaggtgacactataggagcaatcaccagccttgaagtttcagagctatgctggaaacagc

SEQ ID NO: 61137 - DNA, 70 bp, Artificial Sequence
  Synthetic
gccaagcatttaggtgacactataggggcggggtccggcctcagggtttcagagctatgctggaaacagc

SEQ ID NO: 61138 - DNA, 70 bp, Artificial Sequence
  Synthetic
gccaagcatttaggtgacactatagcaatcaccacaacatgatgtgtttcagagctatgctggaaacagc

SEQ ID NO: 61139 - DNA, 70 bp, Artificial Sequence
  Synthetic
gccaagcatttaggtgacactatagaatcatcatggcgcagtacagtttcagagctatgctggaaacagc

SEQ ID NO: 61140 - DNA, 70 bp, Artificial Sequence
  Synthetic
gccaagcatttaggtgacactatagcctctcctctttcttcagtggtttcagagctatgctggaaacagc

SEQ ID NO: 61141 - DNA, 70 bp, Artificial Sequence
  Synthetic
gccaagcatttaggtgacactataggggtttatggcaagctgtgtgtttcagagctatgctggaaacagc

SEQ ID NO: 61142 - DNA, 70 bp, Artificial Sequence
  Synthetic
gccaagcatttaggtgacactatagtcccaggacactggtcatacgtttcagagctatgctggaaacagc

SEQ ID NO: 61143 - DNA, 70 bp, Artificial Sequence
  Synthetic
gccaagcatttaggtgacactatagtctaccgctgcttccctgatgtttcagagctatgctggaaacagc

SEQ ID NO: 61144 - DNA, 70 bp, Artificial Sequence
  Synthetic
gccaagcatttaggtgacactatagcccatccctactagctttctgtttcagagctatgctggaaacagc

SEQ ID NO: 61145 - DNA, 70 bp, Artificial Sequence
  Synthetic
gccaagcatttaggtgacactatagtcaaaacaataagaatccccgtttcagagctatgctggaaacagc

SEQ ID NO: 61146 - DNA, 70 bp, Artificial Sequence
  Synthetic
gccaagcatttaggtgacactatagtcttttctaccttagtcactgtttcagagctatgctggaaacagc

SEQ ID NO: 61147 - DNA, 70 bp, Artificial Sequence
  Synthetic
gccaagcatttaggtgacactatagtgcccattttcaccatttaagtttcagagctatgctggaaacagc

SEQ ID NO: 61148 - DNA, 70 bp, Artificial Sequence
  Synthetic
gccaagcatttaggtgacactatagctccggtcctctttttactggtttcagagctatgctggaaacagc

SEQ ID NO: 61149 - DNA, 70 bp, Artificial Sequence
  Synthetic
gccaagcatttaggtgacactataggggccggcgggcgcttcaccgtttcagagctatgctggaaacagc

SEQ ID NO: 61150 - DNA, 70 bp, Artificial Sequence
  Synthetic
gccaagcatttaggtgacactatagtcagtcgtctcaggtaacttgtttcagagctatgctggaaacagc

SEQ ID NO: 61151 - DNA, 70 bp, Artificial Sequence
  Synthetic
gccaagcatttaggtgacactatagagacacagctggggatcagggtttcagagctatgctggaaacagc

SEQ ID NO: 61152 - DNA, 70 bp, Artificial Sequence
  Synthetic
gccaagcatttaggtgacactatagagccgtgaccacctgctgtggtttcagagctatgctggaaacagc

SEQ ID NO: 61153 - DNA, 70 bp, Artificial Sequence
  Synthetic
gccaagcatttaggtgacactatagcgccgcttccccgactagcggtttcagagctatgctggaaacagc

SEQ ID NO: 61154 - DNA, 70 bp, Artificial Sequence
  Synthetic
gccaagcatttaggtgacactatagctcccccacacgggcttatagtttcagagctatgctggaaacagc

SEQ ID NO: 61155 - DNA, 70 bp, Artificial Sequence
  Synthetic
gccaagcatttaggtgacactatagatatcatgtgacttctgcgagtttcagagctatgctggaaacagc

SEQ ID NO: 61156 - DNA, 70 bp, Artificial Sequence
  Synthetic
gccaagcatttaggtgacactatagaagaaactcatccagtcagcgtttcagagctatgctggaaacagc

SEQ ID NO: 61157 - DNA, 70 bp, Artificial Sequence
  Synthetic
gccaagcatttaggtgacactatagtttgcatgcttaatgggaaagtttcagagctatgctggaaacagc

SEQ ID NO: 61158 - DNA, 70 bp, Artificial Sequence
  Synthetic
gccaagcatttaggtgacactatagtttgcatgtttgatgggcaggtttcagagctatgctggaaacagc

SEQ ID NO: 61159 - DNA, 70 bp, Artificial Sequence
  Synthetic
gccaagcatttaggtgacactatagaaaaatcaggagtgtggtaggtttcagagctatgctggaaacagc

SEQ ID NO: 61160 - DNA, 70 bp, Artificial Sequence
  Synthetic
gccaagcatttaggtgacactatagaaaatgaaagccgtgatgatgtttcagagctatgctggaaacagc

SEQ ID NO: 61161 - DNA, 70 bp, Artificial Sequence
  Synthetic
gccaagcatttaggtgacactatagacaccatggtggcctctaacgtttcagagctatgctggaaacagc

SEQ ID NO: 61162 - DNA, 70 bp, Artificial Sequence
  Synthetic
gccaagcatttaggtgacactatagtctctctatcttgaacgttggtttcagagctatgctggaaacagc

SEQ ID NO: 61163 - DNA, 70 bp, Artificial Sequence
  Synthetic
gccaagcatttaggtgacactatagttctttgaacattcactggcgtttcagagctatgctggaaacagc

SEQ ID NO: 61164 - DNA, 70 bp, Artificial Sequence
  Synthetic
gccaagcatttaggtgacactataggagggctcagacagctgctggtttcagagctatgctggaaacagc

SEQ ID NO: 61165 - DNA, 70 bp, Artificial Sequence
  Synthetic
gccaagcatttaggtgacactatagggggctacagggatgcctgcgtttcagagctatgctggaaacagc

SEQ ID NO: 61166 - DNA, 70 bp, Artificial Sequence
  Synthetic
gccaagcatttaggtgacactatagtgagaaggagggcttcatgggtttcagagctatgctggaaacagc

SEQ ID NO: 61167 - DNA, 70 bp, Artificial Sequence
  Synthetic
gccaagcatttaggtgacactataggaaccagttggagagaaagagtttcagagctatgctggaaacagc

SEQ ID NO: 61168 - DNA, 70 bp, Artificial Sequence
  Synthetic
gccaagcatttaggtgacactatagcagctggggctcagctgctcgtttcagagctatgctggaaacagc

SEQ ID NO: 61169 - DNA, 70 bp, Artificial Sequence
  Synthetic
gccaagcatttaggtgacactatagcatgtccattgagagctgaggtttcagagctatgctggaaacagc

SEQ ID NO: 61170 - DNA, 70 bp, Artificial Sequence
  Synthetic
gccaagcatttaggtgacactataggtgtccagcgacagctaagggtttcagagctatgctggaaacagc

SEQ ID NO: 61171 - DNA, 70 bp, Artificial Sequence
  Synthetic
gccaagcatttaggtgacactatagctcagctgtctaagctcatggtttcagagctatgctggaaacagc

SEQ ID NO: 61172 - DNA, 70 bp, Artificial Sequence
  Synthetic
gccaagcatttaggtgacactataggttgcttcctaaatgtacctgtttcagagctatgctggaaacagc

SEQ ID NO: 61173 - DNA, 70 bp, Artificial Sequence
  Synthetic
gccaagcatttaggtgacactatagttctcagtttgatgaacagcgtttcagagctatgctggaaacagc

SEQ ID NO: 61174 - DNA, 70 bp, Artificial Sequence
  Synthetic
gccaagcatttaggtgacactatagaaacaaggtcacagatctatgtttcagagctatgctggaaacagc

SEQ ID NO: 61175 - DNA, 70 bp, Artificial Sequence
  Synthetic
gccaagcatttaggtgacactatagcactggagattgtaggtcaggtttcagagctatgctggaaacagc

SEQ ID NO: 61176 - DNA, 70 bp, Artificial Sequence
  Synthetic
gccaagcatttaggtgacactatagctgtctgagccagagctcacgtttcagagctatgctggaaacagc

SEQ ID NO: 61177 - DNA, 70 bp, Artificial Sequence
  Synthetic
gccaagcatttaggtgacactatagactagaaagagaacgagggcgtttcagagctatgctggaaacagc

SEQ ID NO: 61178 - DNA, 70 bp, Artificial Sequence
  Synthetic
gccaagcatttaggtgacactatagcatctacgagtgctacagtggtttcagagctatgctggaaacagc

SEQ ID NO: 61179 - DNA, 70 bp, Artificial Sequence
  Synthetic
gccaagcatttaggtgacactatagtctcacctgcacaaactgtggtttcagagctatgctggaaacagc

SEQ ID NO: 61180 - DNA, 70 bp, Artificial Sequence
  Synthetic
gccaagcatttaggtgacactataggttactggaaggaatcagaggtttcagagctatgctggaaacagc

SEQ ID NO: 61181 - DNA, 70 bp, Artificial Sequence
  Synthetic
gccaagcatttaggtgacactatagcagccgcccagtctaatcacgtttcagagctatgctggaaacagc

SEQ ID NO: 61182 - DNA, 70 bp, Artificial Sequence
  Synthetic
gccaagcatttaggtgacactatagaggtatcagacttgccaacagtttcagagctatgctggaaacagc

SEQ ID NO: 61183 - DNA, 70 bp, Artificial Sequence
  Synthetic
gccaagcatttaggtgacactatagccccctcctcagtgggcagcgtttcagagctatgctggaaacagc

SEQ ID NO: 61184 - DNA, 70 bp, Artificial Sequence
  Synthetic
gccaagcatttaggtgacactatagcccccctggggaccctagaggtttcagagctatgctggaaacagc

SEQ ID NO: 61185 - DNA, 70 bp, Artificial Sequence
  Synthetic
gccaagcatttaggtgacactatagggctggcggtctcctcactcgtttcagagctatgctggaaacagc

SEQ ID NO: 61186 - DNA, 70 bp, Artificial Sequence
  Synthetic
gccaagcatttaggtgacactatagggagctggttgctgtgctgagtttcagagctatgctggaaacagc

SEQ ID NO: 61187 - DNA, 70 bp, Artificial Sequence
  Synthetic
gccaagcatttaggtgacactataggagctcacacacctccctccgtttcagagctatgctggaaacagc

SEQ ID NO: 61188 - DNA, 70 bp, Artificial Sequence
  Synthetic
gccaagcatttaggtgacactataggtccaagcaggagggcagcggtttcagagctatgctggaaacagc

SEQ ID NO: 61189 - DNA, 70 bp, Artificial Sequence
  Synthetic
gccaagcatttaggtgacactatagatgtggattctagcagtatggtttcagagctatgctggaaacagc

SEQ ID NO: 61190 - DNA, 70 bp, Artificial Sequence
  Synthetic
gccaagcatttaggtgacactataggagaagggtagcactctcaggtttcagagctatgctggaaacagc

SEQ ID NO: 61191 - DNA, 70 bp, Artificial Sequence
  Synthetic
gccaagcatttaggtgacactatagcttgggactcaatgcctcacgtttcagagctatgctggaaacagc

SEQ ID NO: 61192 - DNA, 70 bp, Artificial Sequence
  Synthetic
gccaagcatttaggtgacactataggagactaaattagaaagggggtttcagagctatgctggaaacagc

SEQ ID NO: 61193 - DNA, 70 bp, Artificial Sequence
  Synthetic
gccaagcatttaggtgacactatagggcctcccagcagagctgaggtttcagagctatgctggaaacagc

SEQ ID NO: 61194 - DNA, 70 bp, Artificial Sequence
  Synthetic
gccaagcatttaggtgacactataggtcaacgtcaatagggtcccgtttcagagctatgctggaaacagc

SEQ ID NO: 61195 - DNA, 70 bp, Artificial Sequence
  Synthetic
gccaagcatttaggtgacactatagtaatgagtgctactctgtgcgtttcagagctatgctggaaacagc

SEQ ID NO: 61196 - DNA, 70 bp, Artificial Sequence
  Synthetic
gccaagcatttaggtgacactatagtggcgccggggaggcaggtagtttcagagctatgctggaaacagc

SEQ ID NO: 61197 - DNA, 70 bp, Artificial Sequence
  Synthetic
gccaagcatttaggtgacactatagacagctcatgaggcgtgaccgtttcagagctatgctggaaacagc

SEQ ID NO: 61198 - DNA, 70 bp, Artificial Sequence
  Synthetic
gccaagcatttaggtgacactataggaactgctgttctcctaacggtttcagagctatgctggaaacagc

SEQ ID NO: 61199 - DNA, 70 bp, Artificial Sequence
  Synthetic
gccaagcatttaggtgacactatagtagaagacaaagaaaggttggtttcagagctatgctggaaacagc

SEQ ID NO: 61200 - DNA, 70 bp, Artificial Sequence
  Synthetic
gccaagcatttaggtgacactataggtgcaccagaatctatgagagtttcagagctatgctggaaacagc

SEQ ID NO: 61201 - DNA, 70 bp, Artificial Sequence
  Synthetic
gccaagcatttaggtgacactatagaagtcaaatgtgtggttaccgtttcagagctatgctggaaacagc

SEQ ID NO: 61202 - DNA, 70 bp, Artificial Sequence
  Synthetic
gccaagcatttaggtgacactatagacagaaagcagtggaggtgggtttcagagctatgctggaaacagc

SEQ ID NO: 61203 - DNA, 70 bp, Artificial Sequence
  Synthetic
gccaagcatttaggtgacactatagaggccggggagcggttctacgtttcagagctatgctggaaacagc

SEQ ID NO: 61204 - DNA, 70 bp, Artificial Sequence
  Synthetic
gccaagcatttaggtgacactatagagatacgcagtaacatgtgtgtttcagagctatgctggaaacagc

SEQ ID NO: 61205 - DNA, 70 bp, Artificial Sequence
  Synthetic
gccaagcatttaggtgacactatagggactgcagtggcatcatctgtttcagagctatgctggaaacagc

SEQ ID NO: 61206 - DNA, 70 bp, Artificial Sequence
  Synthetic
gccaagcatttaggtgacactatagtcatgtagtttctggaagatgtttcagagctatgctggaaacagc

SEQ ID NO: 61207 - DNA, 70 bp, Artificial Sequence
  Synthetic
gccaagcatttaggtgacactatagtttgggcttggtcctgataagtttcagagctatgctggaaacagc

SEQ ID NO: 61208 - DNA, 70 bp, Artificial Sequence
  Synthetic
gccaagcatttaggtgacactatagagttctgagaaatgacacccgtttcagagctatgctggaaacagc

SEQ ID NO: 61209 - DNA, 70 bp, Artificial Sequence
  Synthetic
gccaagcatttaggtgacactatagagaacctagtgactaaagtcgtttcagagctatgctggaaacagc

SEQ ID NO: 61210 - DNA, 70 bp, Artificial Sequence
  Synthetic
gccaagcatttaggtgacactataggtgctggccagccccccaaggtttcagagctatgctggaaacagc

SEQ ID NO: 61211 - DNA, 70 bp, Artificial Sequence
  Synthetic
gccaagcatttaggtgacactatagacaagtctaagtcccgatcagtttcagagctatgctggaaacagc

SEQ ID NO: 61212 - DNA, 70 bp, Artificial Sequence
  Synthetic
gccaagcatttaggtgacactatagagtgaaccagtttgactatcgtttcagagctatgctggaaacagc

SEQ ID NO: 61213 - DNA, 70 bp, Artificial Sequence
  Synthetic
gccaagcatttaggtgacactatagcctccccgtcgtaaacgctggtttcagagctatgctggaaacagc

SEQ ID NO: 61214 - DNA, 70 bp, Artificial Sequence
  Synthetic
gccaagcatttaggtgacactataggtaaacgctgaggaatgatggtttcagagctatgctggaaacagc

SEQ ID NO: 61215 - DNA, 70 bp, Artificial Sequence
  Synthetic
gccaagcatttaggtgacactatagttcaacagaatgtggcaaccgtttcagagctatgctggaaacagc

SEQ ID NO: 61216 - DNA, 70 bp, Artificial Sequence
  Synthetic
gccaagcatttaggtgacactataggggtctggggtgcagacctggtttcagagctatgctggaaacagc

SEQ ID NO: 61217 - DNA, 70 bp, Artificial Sequence
  Synthetic
gccaagcatttaggtgacactatagtcttgtgcatatccttcagcgtttcagagctatgctggaaacagc

SEQ ID NO: 61218 - DNA, 70 bp, Artificial Sequence
  Synthetic
gccaagcatttaggtgacactataggctgggcggggctcagccctgtttcagagctatgctggaaacagc

SEQ ID NO: 61219 - DNA, 70 bp, Artificial Sequence
  Synthetic
gccaagcatttaggtgacactataggcgttcatccttggaagatcgtttcagagctatgctggaaacagc

SEQ ID NO: 61220 - DNA, 70 bp, Artificial Sequence
  Synthetic
gccaagcatttaggtgacactatagataacagtagtctcctaacagtttcagagctatgctggaaacagc

SEQ ID NO: 61221 - DNA, 70 bp, Artificial Sequence
  Synthetic
gccaagcatttaggtgacactatagcgtcgccccgggagcttagcgtttcagagctatgctggaaacagc

SEQ ID NO: 61222 - DNA, 70 bp, Artificial Sequence
  Synthetic
gccaagcatttaggtgacactataggctgcaccacgtttttaacagtttcagagctatgctggaaacagc

SEQ ID NO: 61223 - DNA, 70 bp, Artificial Sequence
  Synthetic
gccaagcatttaggtgacactataggactgtatctgagattagcagtttcagagctatgctggaaacagc

SEQ ID NO: 61224 - DNA, 70 bp, Artificial Sequence
  Synthetic
gccaagcatttaggtgacactataggcactcagaagtgcccttccgtttcagagctatgctggaaacagc

SEQ ID NO: 61225 - DNA, 70 bp, Artificial Sequence
  Synthetic
gccaagcatttaggtgacactatagtatggccgctggaatcatgagtttcagagctatgctggaaacagc

SEQ ID NO: 61226 - DNA, 70 bp, Artificial Sequence
  Synthetic
gccaagcatttaggtgacactatagcaactcatctgctgtttgtcgtttcagagctatgctggaaacagc

SEQ ID NO: 61227 - DNA, 70 bp, Artificial Sequence
  Synthetic
gccaagcatttaggtgacactatagcctgttctcccgagcctactgtttcagagctatgctggaaacagc

SEQ ID NO: 61228 - DNA, 70 bp, Artificial Sequence
  Synthetic
gccaagcatttaggtgacactatagtcccaagccctgggaaacatgtttcagagctatgctggaaacagc

SEQ ID NO: 61229 - DNA, 70 bp, Artificial Sequence
  Synthetic
gccaagcatttaggtgacactataggaggaatgtgataactaggtgtttcagagctatgctggaaacagc

SEQ ID NO: 61230 - DNA, 70 bp, Artificial Sequence
  Synthetic
gccaagcatttaggtgacactatagcaagtcctcccagggcaaatgtttcagagctatgctggaaacagc

SEQ ID NO: 61231 - DNA, 70 bp, Artificial Sequence
  Synthetic
gccaagcatttaggtgacactataggaatccagaaaggtttgatcgtttcagagctatgctggaaacagc

SEQ ID NO: 61232 - DNA, 70 bp, Artificial Sequence
  Synthetic
gccaagcatttaggtgacactataggttctttcaactcctcagtagtttcagagctatgctggaaacagc

SEQ ID NO: 61233 - DNA, 70 bp, Artificial Sequence
  Synthetic
gccaagcatttaggtgacactataggcttcttggggggccactaggtttcagagctatgctggaaacagc

SEQ ID NO: 61234 - DNA, 70 bp, Artificial Sequence
  Synthetic
gccaagcatttaggtgacactatagctcagaaggttgggctgtgagtttcagagctatgctggaaacagc

SEQ ID NO: 61235 - DNA, 70 bp, Artificial Sequence
  Synthetic
gccaagcatttaggtgacactatagggaaagacaaaaggcgttaagtttcagagctatgctggaaacagc

SEQ ID NO: 61236 - DNA, 70 bp, Artificial Sequence
  Synthetic
gccaagcatttaggtgacactataggacacggacaaggatagtttgtttcagagctatgctggaaacagc

SEQ ID NO: 61237 - DNA, 70 bp, Artificial Sequence
  Synthetic
gccaagcatttaggtgacactatagttatggcaatattcgagctggtttcagagctatgctggaaacagc

SEQ ID NO: 61238 - DNA, 70 bp, Artificial Sequence
  Synthetic
gccaagcatttaggtgacactatagccagaatggtaatgtgtagcgtttcagagctatgctggaaacagc

SEQ ID NO: 61239 - DNA, 70 bp, Artificial Sequence
  Synthetic
gccaagcatttaggtgacactatagcgactccaaggcaggtcaacgtttcagagctatgctggaaacagc

SEQ ID NO: 61240 - DNA, 70 bp, Artificial Sequence
  Synthetic
gccaagcatttaggtgacactataggctcactgcactttgctgctgtttcagagctatgctggaaacagc

SEQ ID NO: 61241 - DNA, 70 bp, Artificial Sequence
  Synthetic
gccaagcatttaggtgacactatagggtcggggtctcacagccccgtttcagagctatgctggaaacagc

SEQ ID NO: 61242 - DNA, 70 bp, Artificial Sequence
  Synthetic
gccaagcatttaggtgacactatagactcttctctagtgaaaaacgtttcagagctatgctggaaacagc

SEQ ID NO: 61243 - DNA, 70 bp, Artificial Sequence
  Synthetic
gccaagcatttaggtgacactatagatggaatctttgtatcagtggtttcagagctatgctggaaacagc

SEQ ID NO: 61244 - DNA, 70 bp, Artificial Sequence
  Synthetic
gccaagcatttaggtgacactatagcccacccaccaggcctgagggtttcagagctatgctggaaacagc

SEQ ID NO: 61245 - DNA, 70 bp, Artificial Sequence
  Synthetic
gccaagcatttaggtgacactatagggctcagccacagatgcctggtttcagagctatgctggaaacagc

SEQ ID NO: 61246 - DNA, 70 bp, Artificial Sequence
  Synthetic
gccaagcatttaggtgacactatagcctctgaccaggacgggtaggtttcagagctatgctggaaacagc

SEQ ID NO: 61247 - DNA, 70 bp, Artificial Sequence
  Synthetic
gccaagcatttaggtgacactatagtggatcagctgcagttggaagtttcagagctatgctggaaacagc

SEQ ID NO: 61248 - DNA, 70 bp, Artificial Sequence
  Synthetic
gccaagcatttaggtgacactatagcccaccgcggggaggaagacgtttcagagctatgctggaaacagc

SEQ ID NO: 61249 - DNA, 70 bp, Artificial Sequence
  Synthetic
gccaagcatttaggtgacactataggtcattcaaagttctgaccagtttcagagctatgctggaaacagc

SEQ ID NO: 61250 - DNA, 70 bp, Artificial Sequence
  Synthetic
gccaagcatttaggtgacactatagcaaccaaaacagggagctgagtttcagagctatgctggaaacagc

SEQ ID NO: 61251 - DNA, 70 bp, Artificial Sequence
  Synthetic
gccaagcatttaggtgacactatagtctgaaggattaaaggaaacgtttcagagctatgctggaaacagc

SEQ ID NO: 61252 - DNA, 70 bp, Artificial Sequence
  Synthetic
gccaagcatttaggtgacactatagcagagagcaacaccatgatcgtttcagagctatgctggaaacagc

SEQ ID NO: 61253 - DNA, 70 bp, Artificial Sequence
  Synthetic
gccaagcatttaggtgacactataggcagcgactgactttgacaggtttcagagctatgctggaaacagc

SEQ ID NO: 61254 - DNA, 70 bp, Artificial Sequence
  Synthetic
gccaagcatttaggtgacactatagaatgaacacttgtgagagacgtttcagagctatgctggaaacagc

SEQ ID NO: 61255 - DNA, 70 bp, Artificial Sequence
  Synthetic
gccaagcatttaggtgacactatagggaaaaggaggaggaggaaggtttcagagctatgctggaaacagc

SEQ ID NO: 61256 - DNA, 70 bp, Artificial Sequence
  Synthetic
gccaagcatttaggtgacactatagtcccaaacattctagttagcgtttcagagctatgctggaaacagc

SEQ ID NO: 61257 - DNA, 70 bp, Artificial Sequence
  Synthetic
gccaagcatttaggtgacactataggaagacacacacctctagtcgtttcagagctatgctggaaacagc

SEQ ID NO: 61258 - DNA, 70 bp, Artificial Sequence
  Synthetic
gccaagcatttaggtgacactatagtgcgcctcggctgcgctcacgtttcagagctatgctggaaacagc

SEQ ID NO: 61259 - DNA, 70 bp, Artificial Sequence
  Synthetic
gccaagcatttaggtgacactatagacacttgtgtaagttcacttgtttcagagctatgctggaaacagc

SEQ ID NO: 61260 - DNA, 70 bp, Artificial Sequence
  Synthetic
gccaagcatttaggtgacactatagatagtctgtgtttcactaccgtttcagagctatgctggaaacagc

SEQ ID NO: 61261 - DNA, 70 bp, Artificial Sequence
  Synthetic
gccaagcatttaggtgacactatagagctgcttccagtttcacctgtttcagagctatgctggaaacagc

SEQ ID NO: 61262 - DNA, 70 bp, Artificial Sequence
  Synthetic
gccaagcatttaggtgacactatagggacaggccccctaagctgcgtttcagagctatgctggaaacagc

SEQ ID NO: 61263 - DNA, 70 bp, Artificial Sequence
  Synthetic
gccaagcatttaggtgacactatagtggaagatcacctactgagggtttcagagctatgctggaaacagc

SEQ ID NO: 61264 - DNA, 70 bp, Artificial Sequence
  Synthetic
gccaagcatttaggtgacactatagtgctacaggagactcagacggtttcagagctatgctggaaacagc

SEQ ID NO: 61265 - DNA, 70 bp, Artificial Sequence
  Synthetic
gccaagcatttaggtgacactatagcatggctgagagcaactgaagtttcagagctatgctggaaacagc

SEQ ID NO: 61266 - DNA, 70 bp, Artificial Sequence
  Synthetic
gccaagcatttaggtgacactatagggatgacatcacctgttactgtttcagagctatgctggaaacagc

SEQ ID NO: 61267 - DNA, 70 bp, Artificial Sequence
  Synthetic
gccaagcatttaggtgacactatagagaagctgacctagatctgagtttcagagctatgctggaaacagc

SEQ ID NO: 61268 - DNA, 70 bp, Artificial Sequence
  Synthetic
gccaagcatttaggtgacactataggttgtgccgtgaaatcctaagtttcagagctatgctggaaacagc

SEQ ID NO: 61269 - DNA, 70 bp, Artificial Sequence
  Synthetic
gccaagcatttaggtgacactataggtgcaggtcgtcaggatctggtttcagagctatgctggaaacagc

SEQ ID NO: 61270 - DNA, 70 bp, Artificial Sequence
  Synthetic
gccaagcatttaggtgacactatagcccaaggaccggagcgaatggtttcagagctatgctggaaacagc

SEQ ID NO: 61271 - DNA, 70 bp, Artificial Sequence
  Synthetic
gccaagcatttaggtgacactataggggatgcttgcaaggtcaccgtttcagagctatgctggaaacagc

SEQ ID NO: 61272 - DNA, 70 bp, Artificial Sequence
  Synthetic
gccaagcatttaggtgacactatagaaaccacttttttgagtcaggtttcagagctatgctggaaacagc

SEQ ID NO: 61273 - DNA, 70 bp, Artificial Sequence
  Synthetic
gccaagcatttaggtgacactatagagatggcagtttatttcctcgtttcagagctatgctggaaacagc

SEQ ID NO: 61274 - DNA, 70 bp, Artificial Sequence
  Synthetic
gccaagcatttaggtgacactatagggtcttacgtggtgcctcatgtttcagagctatgctggaaacagc

SEQ ID NO: 61275 - DNA, 70 bp, Artificial Sequence
  Synthetic
gccaagcatttaggtgacactataggtggtgagcaagagagctaagtttcagagctatgctggaaacagc

SEQ ID NO: 61276 - DNA, 70 bp, Artificial Sequence
  Synthetic
gccaagcatttaggtgacactatagaccctcaggccttcactggtgtttcagagctatgctggaaacagc

SEQ ID NO: 61277 - DNA, 70 bp, Artificial Sequence
  Synthetic
gccaagcatttaggtgacactatagttcaaaatcaagctttgagcgtttcagagctatgctggaaacagc

SEQ ID NO: 61278 - DNA, 70 bp, Artificial Sequence
  Synthetic
gccaagcatttaggtgacactatagcggggcccggggctggctaagtttcagagctatgctggaaacagc

SEQ ID NO: 61279 - DNA, 70 bp, Artificial Sequence
  Synthetic
gccaagcatttaggtgacactatagagggtttatgcagaggcattgtttcagagctatgctggaaacagc

SEQ ID NO: 61280 - DNA, 70 bp, Artificial Sequence
  Synthetic
gccaagcatttaggtgacactatagttcttacagggtttatgcaggtttcagagctatgctggaaacagc

SEQ ID NO: 61281 - DNA, 70 bp, Artificial Sequence
  Synthetic
gccaagcatttaggtgacactatagagaagaagaacagaatgaaggtttcagagctatgctggaaacagc

SEQ ID NO: 61282 - DNA, 70 bp, Artificial Sequence
  Synthetic
gccaagcatttaggtgacactatagtgtggatgaatttgcttttcgtttcagagctatgctggaaacagc

SEQ ID NO: 61283 - DNA, 70 bp, Artificial Sequence
  Synthetic
gccaagcatttaggtgacactatagtccaggcagtgctatggtccgtttcagagctatgctggaaacagc

SEQ ID NO: 61284 - DNA, 70 bp, Artificial Sequence
  Synthetic
gccaagcatttaggtgacactatagaagcagagacaccacaatgagtttcagagctatgctggaaacagc

SEQ ID NO: 61285 - DNA, 70 bp, Artificial Sequence
  Synthetic
gccaagcatttaggtgacactataggggcagcactaatgtgttaagtttcagagctatgctggaaacagc

SEQ ID NO: 61286 - DNA, 70 bp, Artificial Sequence
  Synthetic
gccaagcatttaggtgacactatagtgatgacagtaaatgcatcagtttcagagctatgctggaaacagc

SEQ ID NO: 61287 - DNA, 70 bp, Artificial Sequence
  Synthetic
gccaagcatttaggtgacactataggacaaacttgtgaagctagagtttcagagctatgctggaaacagc

SEQ ID NO: 61288 - DNA, 70 bp, Artificial Sequence
  Synthetic
gccaagcatttaggtgacactataggcaggatcagatttccacatgtttcagagctatgctggaaacagc

SEQ ID NO: 61289 - DNA, 70 bp, Artificial Sequence
  Synthetic
gccaagcatttaggtgacactatagagggtatgtttgggattgttgtttcagagctatgctggaaacagc

SEQ ID NO: 61290 - DNA, 70 bp, Artificial Sequence
  Synthetic
gccaagcatttaggtgacactataggagaacctgctgagcgggacgtttcagagctatgctggaaacagc

SEQ ID NO: 61291 - DNA, 70 bp, Artificial Sequence
  Synthetic
gccaagcatttaggtgacactatagcccagggtcacacagtgatggtttcagagctatgctggaaacagc

SEQ ID NO: 61292 - DNA, 70 bp, Artificial Sequence
  Synthetic
gccaagcatttaggtgacactataggctcaggcgtttctctgctcgtttcagagctatgctggaaacagc

SEQ ID NO: 61293 - DNA, 70 bp, Artificial Sequence
  Synthetic
gccaagcatttaggtgacactatagtggggctacagacaaaatgagtttcagagctatgctggaaacagc

SEQ ID NO: 61294 - DNA, 70 bp, Artificial Sequence
  Synthetic
gccaagcatttaggtgacactatagcgccagctggggagagctaagtttcagagctatgctggaaacagc

SEQ ID NO: 61295 - DNA, 70 bp, Artificial Sequence
  Synthetic
gccaagcatttaggtgacactatagcggggtagctgctatctcaggtttcagagctatgctggaaacagc

SEQ ID NO: 61296 - DNA, 70 bp, Artificial Sequence
  Synthetic
gccaagcatttaggtgacactatagtcggtattttgtagctgaacgtttcagagctatgctggaaacagc

SEQ ID NO: 61297 - DNA, 70 bp, Artificial Sequence
  Synthetic
gccaagcatttaggtgacactatagggccaaggcgagtggatcacgtttcagagctatgctggaaacagc

SEQ ID NO: 61298 - DNA, 70 bp, Artificial Sequence
  Synthetic
gccaagcatttaggtgacactatagtgaactagatgcggttcagagtttcagagctatgctggaaacagc

SEQ ID NO: 61299 - DNA, 70 bp, Artificial Sequence
  Synthetic
gccaagcatttaggtgacactatagaagcggtccaaccggcggtggtttcagagctatgctggaaacagc

SEQ ID NO: 61300 - DNA, 70 bp, Artificial Sequence
  Synthetic
gccaagcatttaggtgacactatagctgcataaaggactagaatggtttcagagctatgctggaaacagc

SEQ ID NO: 61301 - DNA, 70 bp, Artificial Sequence
  Synthetic
gccaagcatttaggtgacactatagcagaccgcctggcaaagcgggtttcagagctatgctggaaacagc

SEQ ID NO: 61302 - DNA, 70 bp, Artificial Sequence
  Synthetic
gccaagcatttaggtgacactatagacagtgacgaggagaactgagtttcagagctatgctggaaacagc

SEQ ID NO: 61303 - DNA, 70 bp, Artificial Sequence
  Synthetic
gccaagcatttaggtgacactatagagctaaacactcatcattcggtttcagagctatgctggaaacagc

SEQ ID NO: 61304 - DNA, 70 bp, Artificial Sequence
  Synthetic
gccaagcatttaggtgacactatagggcaagctgcagttaatttagtttcagagctatgctggaaacagc

SEQ ID NO: 61305 - DNA, 70 bp, Artificial Sequence
  Synthetic
gccaagcatttaggtgacactatagactgaaagctgcgctttgtcgtttcagagctatgctggaaacagc

SEQ ID NO: 61306 - DNA, 70 bp, Artificial Sequence
  Synthetic
gccaagcatttaggtgacactataggcggtagctactgcaccagcgtttcagagctatgctggaaacagc

SEQ ID NO: 61307 - DNA, 70 bp, Artificial Sequence
  Synthetic
gccaagcatttaggtgacactatagttttaatcgggtgttttctggtttcagagctatgctggaaacagc

SEQ ID NO: 61308 - DNA, 70 bp, Artificial Sequence
  Synthetic
gccaagcatttaggtgacactatagaagccacccattgtttcctagtttcagagctatgctggaaacagc

SEQ ID NO: 61309 - DNA, 70 bp, Artificial Sequence
  Synthetic
gccaagcatttaggtgacactatagctctctgagccgccgcctccgtttcagagctatgctggaaacagc

SEQ ID NO: 61310 - DNA, 70 bp, Artificial Sequence
  Synthetic
gccaagcatttaggtgacactatagtcctctgctcattgccatgagtttcagagctatgctggaaacagc

SEQ ID NO: 61311 - DNA, 70 bp, Artificial Sequence
  Synthetic
gccaagcatttaggtgacactatagtccctgatggacgattacttgtttcagagctatgctggaaacagc

SEQ ID NO: 61312 - DNA, 70 bp, Artificial Sequence
  Synthetic
gccaagcatttaggtgacactatagaatgcgtgggggcctaacccgtttcagagctatgctggaaacagc

SEQ ID NO: 61313 - DNA, 70 bp, Artificial Sequence
  Synthetic
gccaagcatttaggtgacactatagagagaggctggcttcaggcggtttcagagctatgctggaaacagc

SEQ ID NO: 61314 - DNA, 70 bp, Artificial Sequence
  Synthetic
gccaagcatttaggtgacactatagggcttcaggcgaggttcagagtttcagagctatgctggaaacagc

SEQ ID NO: 61315 - DNA, 70 bp, Artificial Sequence
  Synthetic
gccaagcatttaggtgacactatagtgagagtgaatctttcaagagtttcagagctatgctggaaacagc

SEQ ID NO: 61316 - DNA, 70 bp, Artificial Sequence
  Synthetic
gccaagcatttaggtgacactatagtgaggatattttcgatgtgagtttcagagctatgctggaaacagc

SEQ ID NO: 61317 - DNA, 70 bp, Artificial Sequence
  Synthetic
gccaagcatttaggtgacactataggggggagagaggaggtcactgtttcagagctatgctggaaacagc

SEQ ID NO: 61318 - DNA, 70 bp, Artificial Sequence
  Synthetic
gccaagcatttaggtgacactatagagcaggaaggaattgagtaggtttcagagctatgctggaaacagc

SEQ ID NO: 61319 - DNA, 70 bp, Artificial Sequence
  Synthetic
gccaagcatttaggtgacactataggaaggggaagcaggcacgtcgtttcagagctatgctggaaacagc

SEQ ID NO: 61320 - DNA, 70 bp, Artificial Sequence
  Synthetic
gccaagcatttaggtgacactatagccaatcagatgcagagaatggtttcagagctatgctggaaacagc

SEQ ID NO: 61321 - DNA, 70 bp, Artificial Sequence
  Synthetic
gccaagcatttaggtgacactatagcctccttctgggtgttcttcgtttcagagctatgctggaaacagc

SEQ ID NO: 61322 - DNA, 70 bp, Artificial Sequence
  Synthetic
gccaagcatttaggtgacactatagtaagggatgaagatgacgatgtttcagagctatgctggaaacagc

SEQ ID NO: 61323 - DNA, 70 bp, Artificial Sequence
  Synthetic
gccaagcatttaggtgacactatagtttctttggactatgtgacagtttcagagctatgctggaaacagc

SEQ ID NO: 61324 - DNA, 70 bp, Artificial Sequence
  Synthetic
gccaagcatttaggtgacactatagctgtccaagtacaatgaatggtttcagagctatgctggaaacagc

SEQ ID NO: 61325 - DNA, 70 bp, Artificial Sequence
  Synthetic
gccaagcatttaggtgacactatagtctggatcactgtctcttcagtttcagagctatgctggaaacagc

SEQ ID NO: 61326 - DNA, 70 bp, Artificial Sequence
  Synthetic
gccaagcatttaggtgacactatagcctccacctgctcattttacgtttcagagctatgctggaaacagc

SEQ ID NO: 61327 - DNA, 70 bp, Artificial Sequence
  Synthetic
gccaagcatttaggtgacactatagaagactgtactgtccctttagtttcagagctatgctggaaacagc

SEQ ID NO: 61328 - DNA, 70 bp, Artificial Sequence
  Synthetic
gccaagcatttaggtgacactatagactgtatttacatgacagaggtttcagagctatgctggaaacagc

SEQ ID NO: 61329 - DNA, 70 bp, Artificial Sequence
  Synthetic
gccaagcatttaggtgacactatagcatggatgaggcaacctattgtttcagagctatgctggaaacagc

SEQ ID NO: 61330 - DNA, 70 bp, Artificial Sequence
  Synthetic
gccaagcatttaggtgacactatagcagtgatgacaatatggacggtttcagagctatgctggaaacagc

SEQ ID NO: 61331 - DNA, 70 bp, Artificial Sequence
  Synthetic
gccaagcatttaggtgacactataggaagtccttcaggccctgaagtttcagagctatgctggaaacagc

SEQ ID NO: 61332 - DNA, 70 bp, Artificial Sequence
  Synthetic
gccaagcatttaggtgacactatagggacaccgctggagggattagtttcagagctatgctggaaacagc

SEQ ID NO: 61333 - DNA, 70 bp, Artificial Sequence
  Synthetic
gccaagcatttaggtgacactatagggggtgtcagctgaagaagtgtttcagagctatgctggaaacagc

SEQ ID NO: 61334 - DNA, 70 bp, Artificial Sequence
  Synthetic
gccaagcatttaggtgacactataggctccgggctcactccttccgtttcagagctatgctggaaacagc

SEQ ID NO: 61335 - DNA, 70 bp, Artificial Sequence
  Synthetic
gccaagcatttaggtgacactataggggacaaaggctactttttggtttcagagctatgctggaaacagc

SEQ ID NO: 61336 - DNA, 70 bp, Artificial Sequence
  Synthetic
gccaagcatttaggtgacactatagcccagattcttaggagccaagtttcagagctatgctggaaacagc

SEQ ID NO: 61337 - DNA, 70 bp, Artificial Sequence
  Synthetic
gccaagcatttaggtgacactatagtcttgtaggcatgatgccttgtttcagagctatgctggaaacagc

SEQ ID NO: 61338 - DNA, 70 bp, Artificial Sequence
  Synthetic
gccaagcatttaggtgacactatagcctacaagaagggcgagtgagtttcagagctatgctggaaacagc

SEQ ID NO: 61339 - DNA, 70 bp, Artificial Sequence
  Synthetic
gccaagcatttaggtgacactatagaggaggtctcatgtctgttcgtttcagagctatgctggaaacagc

SEQ ID NO: 61340 - DNA, 70 bp, Artificial Sequence
  Synthetic
gccaagcatttaggtgacactatagatttccaaagctggataagtgtttcagagctatgctggaaacagc

SEQ ID NO: 61341 - DNA, 70 bp, Artificial Sequence
  Synthetic
gccaagcatttaggtgacactataggggaccctttgcagatgtgcgtttcagagctatgctggaaacagc

SEQ ID NO: 61342 - DNA, 70 bp, Artificial Sequence
  Synthetic
gccaagcatttaggtgacactatagtagagatgccatgatgtctcgtttcagagctatgctggaaacagc

SEQ ID NO: 61343 - DNA, 70 bp, Artificial Sequence
  Synthetic
gccaagcatttaggtgacactataggggagagccacacttgatgggtttcagagctatgctggaaacagc

SEQ ID NO: 61344 - DNA, 70 bp, Artificial Sequence
  Synthetic
gccaagcatttaggtgacactatagccttcgctggaaagacagctgtttcagagctatgctggaaacagc

SEQ ID NO: 61345 - DNA, 70 bp, Artificial Sequence
  Synthetic
gccaagcatttaggtgacactatagctggactcatgggacttttggtttcagagctatgctggaaacagc

SEQ ID NO: 61346 - DNA, 70 bp, Artificial Sequence
  Synthetic
gccaagcatttaggtgacactatagcggttacagggaagcagacggtttcagagctatgctggaaacagc

SEQ ID NO: 61347 - DNA, 70 bp, Artificial Sequence
  Synthetic
gccaagcatttaggtgacactatagttctggagtcattagcaaaggtttcagagctatgctggaaacagc

SEQ ID NO: 61348 - DNA, 70 bp, Artificial Sequence
  Synthetic
gccaagcatttaggtgacactatagtacaaagggaaactgctgatgtttcagagctatgctggaaacagc

SEQ ID NO: 61349 - DNA, 70 bp, Artificial Sequence
  Synthetic
gccaagcatttaggtgacactataggttcacaatacaaggctctggtttcagagctatgctggaaacagc

SEQ ID NO: 61350 - DNA, 70 bp, Artificial Sequence
  Synthetic
gccaagcatttaggtgacactatagtaccatgggaaaattctcatgtttcagagctatgctggaaacagc

SEQ ID NO: 61351 - DNA, 70 bp, Artificial Sequence
  Synthetic
gccaagcatttaggtgacactatagatttgcgaggattgctattggtttcagagctatgctggaaacagc

SEQ ID NO: 61352 - DNA, 70 bp, Artificial Sequence
  Synthetic
gccaagcatttaggtgacactatagtttcctttcatggcatttctgtttcagagctatgctggaaacagc

SEQ ID NO: 61353 - DNA, 70 bp, Artificial Sequence
  Synthetic
gccaagcatttaggtgacactatagttagacggcaaagaattcacgtttcagagctatgctggaaacagc

SEQ ID NO: 61354 - DNA, 70 bp, Artificial Sequence
  Synthetic
gccaagcatttaggtgacactatagtgaggaggctgcagaagcaagtttcagagctatgctggaaacagc

SEQ ID NO: 61355 - DNA, 70 bp, Artificial Sequence
  Synthetic
gccaagcatttaggtgacactatagcatccacatccgagtcttcagtttcagagctatgctggaaacagc

SEQ ID NO: 61356 - DNA, 70 bp, Artificial Sequence
  Synthetic
gccaagcatttaggtgacactatagacccacacgcctgaactttagtttcagagctatgctggaaacagc

SEQ ID NO: 61357 - DNA, 70 bp, Artificial Sequence
  Synthetic
gccaagcatttaggtgacactatagttttcagggaaggtggcagcgtttcagagctatgctggaaacagc

SEQ ID NO: 61358 - DNA, 70 bp, Artificial Sequence
  Synthetic
gccaagcatttaggtgacactatagtcatttatcacagtatcgtcgtttcagagctatgctggaaacagc

SEQ ID NO: 61359 - DNA, 70 bp, Artificial Sequence
  Synthetic
gccaagcatttaggtgacactatagccctggacgtgtggagctaggtttcagagctatgctggaaacagc

SEQ ID NO: 61360 - DNA, 70 bp, Artificial Sequence
  Synthetic
gccaagcatttaggtgacactatagttctaccgtctcataggctggtttcagagctatgctggaaacagc

SEQ ID NO: 61361 - DNA, 70 bp, Artificial Sequence
  Synthetic
gccaagcatttaggtgacactatagtctagaagacgattaagggagtttcagagctatgctggaaacagc

SEQ ID NO: 61362 - DNA, 70 bp, Artificial Sequence
  Synthetic
gccaagcatttaggtgacactataggattacatcttctgcaactggtttcagagctatgctggaaacagc

SEQ ID NO: 61363 - DNA, 70 bp, Artificial Sequence
  Synthetic
gccaagcatttaggtgacactatagctactgtaagttgctcataggtttcagagctatgctggaaacagc

SEQ ID NO: 61364 - DNA, 70 bp, Artificial Sequence
  Synthetic
gccaagcatttaggtgacactatagtgtccactgtacttaaatacgtttcagagctatgctggaaacagc

SEQ ID NO: 61365 - DNA, 70 bp, Artificial Sequence
  Synthetic
gccaagcatttaggtgacactatagccatgctaatttctggagacgtttcagagctatgctggaaacagc

SEQ ID NO: 61366 - DNA, 70 bp, Artificial Sequence
  Synthetic
gccaagcatttaggtgacactatagccaccgcaaatgcttgtagggtttcagagctatgctggaaacagc

SEQ ID NO: 61367 - DNA, 70 bp, Artificial Sequence
  Synthetic
gccaagcatttaggtgacactataggcatttgcggtggacaatgggtttcagagctatgctggaaacagc

SEQ ID NO: 61368 - DNA, 70 bp, Artificial Sequence
  Synthetic
gccaagcatttaggtgacactatagtgaagaaaagcagatagaaggtttcagagctatgctggaaacagc

SEQ ID NO: 61369 - DNA, 70 bp, Artificial Sequence
  Synthetic
gccaagcatttaggtgacactatagccggaggcagagagaaaaacgtttcagagctatgctggaaacagc

SEQ ID NO: 61370 - DNA, 70 bp, Artificial Sequence
  Synthetic
gccaagcatttaggtgacactatagtctctctgtggaaggcttttgtttcagagctatgctggaaacagc

SEQ ID NO: 61371 - DNA, 70 bp, Artificial Sequence
  Synthetic
gccaagcatttaggtgacactataggcctccaaggcacagtgagcgtttcagagctatgctggaaacagc

SEQ ID NO: 61372 - DNA, 70 bp, Artificial Sequence
  Synthetic
gccaagcatttaggtgacactatagctgccccttaccagccttgagtttcagagctatgctggaaacagc

SEQ ID NO: 61373 - DNA, 70 bp, Artificial Sequence
  Synthetic
gccaagcatttaggtgacactatagaaccccagcacggggtaagtgtttcagagctatgctggaaacagc

SEQ ID NO: 61374 - DNA, 70 bp, Artificial Sequence
  Synthetic
gccaagcatttaggtgacactatagcactcggctatcggcttgtcgtttcagagctatgctggaaacagc

SEQ ID NO: 61375 - DNA, 70 bp, Artificial Sequence
  Synthetic
gccaagcatttaggtgacactataggagaaactttttggtctcaggtttcagagctatgctggaaacagc

SEQ ID NO: 61376 - DNA, 70 bp, Artificial Sequence
  Synthetic
gccaagcatttaggtgacactataggcggggtcactgcactgagcgtttcagagctatgctggaaacagc

SEQ ID NO: 61377 - DNA, 70 bp, Artificial Sequence
  Synthetic
gccaagcatttaggtgacactatagctcccccagctcgagttcacgtttcagagctatgctggaaacagc

SEQ ID NO: 61378 - DNA, 70 bp, Artificial Sequence
  Synthetic
gccaagcatttaggtgacactataggaacgctcgtctgcagcccggtttcagagctatgctggaaacagc

SEQ ID NO: 61379 - DNA, 70 bp, Artificial Sequence
  Synthetic
gccaagcatttaggtgacactatagatcttgccatgatctctgacgtttcagagctatgctggaaacagc

SEQ ID NO: 61380 - DNA, 70 bp, Artificial Sequence
  Synthetic
gccaagcatttaggtgacactatagttctctgccacttactgagggtttcagagctatgctggaaacagc

SEQ ID NO: 61381 - DNA, 70 bp, Artificial Sequence
  Synthetic
gccaagcatttaggtgacactataggccaagagtcttctaaatgcgtttcagagctatgctggaaacagc

SEQ ID NO: 61382 - DNA, 70 bp, Artificial Sequence
  Synthetic
gccaagcatttaggtgacactatagctgcgccctgccgcaatcaggtttcagagctatgctggaaacagc

SEQ ID NO: 61383 - DNA, 70 bp, Artificial Sequence
  Synthetic
gccaagcatttaggtgacactatagtctcccatgcattcaaactggtttcagagctatgctggaaacagc

SEQ ID NO: 61384 - DNA, 70 bp, Artificial Sequence
  Synthetic
gccaagcatttaggtgacactatagctgggcctcctcagattttagtttcagagctatgctggaaacagc

SEQ ID NO: 61385 - DNA, 70 bp, Artificial Sequence
  Synthetic
gccaagcatttaggtgacactatagggccaggggctgagccctaagtttcagagctatgctggaaacagc

SEQ ID NO: 61386 - DNA, 70 bp, Artificial Sequence
  Synthetic
gccaagcatttaggtgacactatagaaacgcctcctcctctataagtttcagagctatgctggaaacagc

SEQ ID NO: 61387 - DNA, 70 bp, Artificial Sequence
  Synthetic
gccaagcatttaggtgacactatagggagcccttaacagactctcgtttcagagctatgctggaaacagc

SEQ ID NO: 61388 - DNA, 70 bp, Artificial Sequence
  Synthetic
gccaagcatttaggtgacactataggtaaatgctgctttactggcgtttcagagctatgctggaaacagc

SEQ ID NO: 61389 - DNA, 70 bp, Artificial Sequence
  Synthetic
gccaagcatttaggtgacactatagctgcacagtaccaacagacggtttcagagctatgctggaaacagc

SEQ ID NO: 61390 - DNA, 70 bp, Artificial Sequence
  Synthetic
gccaagcatttaggtgacactataggatgtttcaatcacttgccagtttcagagctatgctggaaacagc

SEQ ID NO: 61391 - DNA, 70 bp, Artificial Sequence
  Synthetic
gccaagcatttaggtgacactataggggccgcccagggaagagaggtttcagagctatgctggaaacagc

SEQ ID NO: 61392 - DNA, 70 bp, Artificial Sequence
  Synthetic
gccaagcatttaggtgacactataggcagcgtcagggcgcagagcgtttcagagctatgctggaaacagc

SEQ ID NO: 61393 - DNA, 70 bp, Artificial Sequence
  Synthetic
gccaagcatttaggtgacactataggctactgcaggagatctacagtttcagagctatgctggaaacagc

SEQ ID NO: 61394 - DNA, 70 bp, Artificial Sequence
  Synthetic
gccaagcatttaggtgacactataggcggccatcattctgtgtgggtttcagagctatgctggaaacagc

SEQ ID NO: 61395 - DNA, 70 bp, Artificial Sequence
  Synthetic
gccaagcatttaggtgacactatagtctacaaggacatgtactaagtttcagagctatgctggaaacagc

SEQ ID NO: 61396 - DNA, 70 bp, Artificial Sequence
  Synthetic
gccaagcatttaggtgacactataggctcctgcaggagatctacagtttcagagctatgctggaaacagc

SEQ ID NO: 61397 - DNA, 70 bp, Artificial Sequence
  Synthetic
gccaagcatttaggtgacactatagggcttcacattcagcaaaccgtttcagagctatgctggaaacagc

SEQ ID NO: 61398 - DNA, 70 bp, Artificial Sequence
  Synthetic
gccaagcatttaggtgacactatagaagctcagagaagcttgcgcgtttcagagctatgctggaaacagc

SEQ ID NO: 61399 - DNA, 70 bp, Artificial Sequence
  Synthetic
gccaagcatttaggtgacactataggttaaggctgttatcaatgcgtttcagagctatgctggaaacagc

SEQ ID NO: 61400 - DNA, 70 bp, Artificial Sequence
  Synthetic
gccaagcatttaggtgacactatagtgtagaattagaatggtagcgtttcagagctatgctggaaacagc

SEQ ID NO: 61401 - DNA, 70 bp, Artificial Sequence
  Synthetic
gccaagcatttaggtgacactatagttcttgattctgggagcatcgtttcagagctatgctggaaacagc

SEQ ID NO: 61402 - DNA, 70 bp, Artificial Sequence
  Synthetic
gccaagcatttaggtgacactataggaaactcccaaggctcagccgtttcagagctatgctggaaacagc

SEQ ID NO: 61403 - DNA, 70 bp, Artificial Sequence
  Synthetic
gccaagcatttaggtgacactatagggcttccagcagagttgaccgtttcagagctatgctggaaacagc

SEQ ID NO: 61404 - DNA, 70 bp, Artificial Sequence
  Synthetic
gccaagcatttaggtgacactatagctggggaacccgagttgagagtttcagagctatgctggaaacagc

SEQ ID NO: 61405 - DNA, 70 bp, Artificial Sequence
  Synthetic
gccaagcatttaggtgacactatagagcacagtgaagacaggctggtttcagagctatgctggaaacagc

SEQ ID NO: 61406 - DNA, 70 bp, Artificial Sequence
  Synthetic
gccaagcatttaggtgacactatagtctcgacacacagcttttatgtttcagagctatgctggaaacagc

SEQ ID NO: 61407 - DNA, 70 bp, Artificial Sequence
  Synthetic
gccaagcatttaggtgacactataggccacaggcggtcatgctgcgtttcagagctatgctggaaacagc

SEQ ID NO: 61408 - DNA, 70 bp, Artificial Sequence
  Synthetic
gccaagcatttaggtgacactatagggtaaccgctcaggtcaggagtttcagagctatgctggaaacagc

SEQ ID NO: 61409 - DNA, 70 bp, Artificial Sequence
  Synthetic
gccaagcatttaggtgacactatagataaaagatctgtctgctacgtttcagagctatgctggaaacagc

SEQ ID NO: 61410 - DNA, 70 bp, Artificial Sequence
  Synthetic
gccaagcatttaggtgacactatagtaaaagatctgtctgctactgtttcagagctatgctggaaacagc

SEQ ID NO: 61411 - DNA, 70 bp, Artificial Sequence
  Synthetic
gccaagcatttaggtgacactatagctctcatttgtgtttagccagtttcagagctatgctggaaacagc

SEQ ID NO: 61412 - DNA, 70 bp, Artificial Sequence
  Synthetic
gccaagcatttaggtgacactatagggctgttcttagtgtgcaccgtttcagagctatgctggaaacagc

SEQ ID NO: 61413 - DNA, 70 bp, Artificial Sequence
  Synthetic
gccaagcatttaggtgacactatagggttggattctgctacagtcgtttcagagctatgctggaaacagc

SEQ ID NO: 61414 - DNA, 70 bp, Artificial Sequence
  Synthetic
gccaagcatttaggtgacactataggcagatggacggtatgtgatgtttcagagctatgctggaaacagc

SEQ ID NO: 61415 - DNA, 70 bp, Artificial Sequence
  Synthetic
gccaagcatttaggtgacactatagacatgagtatgtgcgaacaggtttcagagctatgctggaaacagc

SEQ ID NO: 61416 - DNA, 70 bp, Artificial Sequence
  Synthetic
gccaagcatttaggtgacactatagcatttttcttgactgcccaggtttcagagctatgctggaaacagc

SEQ ID NO: 61417 - DNA, 70 bp, Artificial Sequence
  Synthetic
gccaagcatttaggtgacactatagacctggaggcctgcactagcgtttcagagctatgctggaaacagc

SEQ ID NO: 61418 - DNA, 70 bp, Artificial Sequence
  Synthetic
gccaagcatttaggtgacactatagctgggggccatggctagtccgtttcagagctatgctggaaacagc

SEQ ID NO: 61419 - DNA, 70 bp, Artificial Sequence
  Synthetic
gccaagcatttaggtgacactatagtgagtcttcatctgtaatgcgtttcagagctatgctggaaacagc

SEQ ID NO: 61420 - DNA, 70 bp, Artificial Sequence
  Synthetic
gccaagcatttaggtgacactatagaggcccgtggaccacagtctgtttcagagctatgctggaaacagc

SEQ ID NO: 61421 - DNA, 70 bp, Artificial Sequence
  Synthetic
gccaagcatttaggtgacactatagatcagctaatctgtcccaccgtttcagagctatgctggaaacagc

SEQ ID NO: 61422 - DNA, 70 bp, Artificial Sequence
  Synthetic
gccaagcatttaggtgacactatagctgcccccaactctgatgacgtttcagagctatgctggaaacagc

SEQ ID NO: 61423 - DNA, 70 bp, Artificial Sequence
  Synthetic
gccaagcatttaggtgacactatagagcagttactgcttgttttcgtttcagagctatgctggaaacagc

SEQ ID NO: 61424 - DNA, 70 bp, Artificial Sequence
  Synthetic
gccaagcatttaggtgacactatagaggctctccaaaatcttgaggtttcagagctatgctggaaacagc

SEQ ID NO: 61425 - DNA, 70 bp, Artificial Sequence
  Synthetic
gccaagcatttaggtgacactatagtctcacctgttcaatctcttgtttcagagctatgctggaaacagc

SEQ ID NO: 61426 - DNA, 70 bp, Artificial Sequence
  Synthetic
gccaagcatttaggtgacactatagtggaggccatggagcgctttgtttcagagctatgctggaaacagc

SEQ ID NO: 61427 - DNA, 70 bp, Artificial Sequence
  Synthetic
gccaagcatttaggtgacactataggaattgtccacagtcagcaagtttcagagctatgctggaaacagc

SEQ ID NO: 61428 - DNA, 70 bp, Artificial Sequence
  Synthetic
gccaagcatttaggtgacactatagtttgccatcgccaaggagtagtttcagagctatgctggaaacagc

SEQ ID NO: 61429 - DNA, 70 bp, Artificial Sequence
  Synthetic
gccaagcatttaggtgacactatagttgtggttgagatcgctgatgtttcagagctatgctggaaacagc

SEQ ID NO: 61430 - DNA, 70 bp, Artificial Sequence
  Synthetic
gccaagcatttaggtgacactatagggcacagaaagataaagagagtttcagagctatgctggaaacagc

SEQ ID NO: 61431 - DNA, 70 bp, Artificial Sequence
  Synthetic
gccaagcatttaggtgacactatagcgagctctacgtcagcttccgtttcagagctatgctggaaacagc

SEQ ID NO: 61432 - DNA, 70 bp, Artificial Sequence
  Synthetic
gccaagcatttaggtgacactataggcaggcaggaagcttctagagtttcagagctatgctggaaacagc

SEQ ID NO: 61433 - DNA, 70 bp, Artificial Sequence
  Synthetic
gccaagcatttaggtgacactatagtgtggggagtacgtgtgagggtttcagagctatgctggaaacagc

SEQ ID NO: 61434 - DNA, 70 bp, Artificial Sequence
  Synthetic
gccaagcatttaggtgacactatagtggccacagattagctcaacgtttcagagctatgctggaaacagc

SEQ ID NO: 61435 - DNA, 70 bp, Artificial Sequence
  Synthetic
gccaagcatttaggtgacactatagggaacagatgaagacaaaaggtttcagagctatgctggaaacagc

SEQ ID NO: 61436 - DNA, 70 bp, Artificial Sequence
  Synthetic
gccaagcatttaggtgacactatagtgtggtgatctcgcagtgtggtttcagagctatgctggaaacagc

SEQ ID NO: 61437 - DNA, 70 bp, Artificial Sequence
  Synthetic
gccaagcatttaggtgacactataggggtagcaagtctacccagagtttcagagctatgctggaaacagc

SEQ ID NO: 61438 - DNA, 70 bp, Artificial Sequence
  Synthetic
gccaagcatttaggtgacactataggcggccaacctgctgctaccgtttcagagctatgctggaaacagc

SEQ ID NO: 61439 - DNA, 70 bp, Artificial Sequence
  Synthetic
gccaagcatttaggtgacactataggttttggggacttcagctccgtttcagagctatgctggaaacagc

SEQ ID NO: 61440 - DNA, 70 bp, Artificial Sequence
  Synthetic
gccaagcatttaggtgacactatagaggggcagacatacctctaggtttcagagctatgctggaaacagc

SEQ ID NO: 61441 - DNA, 70 bp, Artificial Sequence
  Synthetic
gccaagcatttaggtgacactatagtatcatagctactgagcaaagtttcagagctatgctggaaacagc

SEQ ID NO: 61442 - DNA, 70 bp, Artificial Sequence
  Synthetic
gccaagcatttaggtgacactatagacttctttggacttctgcttgtttcagagctatgctggaaacagc

SEQ ID NO: 61443 - DNA, 70 bp, Artificial Sequence
  Synthetic
gccaagcatttaggtgacactataggaatggctggatacaaggaggtttcagagctatgctggaaacagc

SEQ ID NO: 61444 - DNA, 70 bp, Artificial Sequence
  Synthetic
gccaagcatttaggtgacactatagatgtgtagaattactgacaggtttcagagctatgctggaaacagc

SEQ ID NO: 61445 - DNA, 70 bp, Artificial Sequence
  Synthetic
gccaagcatttaggtgacactataggcaggcccaggaggtccctggtttcagagctatgctggaaacagc

SEQ ID NO: 61446 - DNA, 70 bp, Artificial Sequence
  Synthetic
gccaagcatttaggtgacactatagttgttcctaatacctcatctgtttcagagctatgctggaaacagc

SEQ ID NO: 61447 - DNA, 70 bp, Artificial Sequence
  Synthetic
gccaagcatttaggtgacactatagcttggtatctgggcagaagtgtttcagagctatgctggaaacagc

SEQ ID NO: 61448 - DNA, 70 bp, Artificial Sequence
  Synthetic
gccaagcatttaggtgacactatagcctcccaccagggggtgaatgtttcagagctatgctggaaacagc

SEQ ID NO: 61449 - DNA, 70 bp, Artificial Sequence
  Synthetic
gccaagcatttaggtgacactatagctggaatgcagagtagaagggtttcagagctatgctggaaacagc

SEQ ID NO: 61450 - DNA, 70 bp, Artificial Sequence
  Synthetic
gccaagcatttaggtgacactataggatgcagggacaaagatgaggtttcagagctatgctggaaacagc

SEQ ID NO: 61451 - DNA, 70 bp, Artificial Sequence
  Synthetic
gccaagcatttaggtgacactatagatccacatagagaaagtgatgtttcagagctatgctggaaacagc

SEQ ID NO: 61452 - DNA, 70 bp, Artificial Sequence
  Synthetic
gccaagcatttaggtgacactataggaaggtttttaaggctaccagtttcagagctatgctggaaacagc

SEQ ID NO: 61453 - DNA, 70 bp, Artificial Sequence
  Synthetic
gccaagcatttaggtgacactatagatcctttacttcatcaacacgtttcagagctatgctggaaacagc

SEQ ID NO: 61454 - DNA, 70 bp, Artificial Sequence
  Synthetic
gccaagcatttaggtgacactatagttccatgcccagatcttcctgtttcagagctatgctggaaacagc

SEQ ID NO: 61455 - DNA, 70 bp, Artificial Sequence
  Synthetic
gccaagcatttaggtgacactatagggctccaccaagaagctagggtttcagagctatgctggaaacagc

SEQ ID NO: 61456 - DNA, 70 bp, Artificial Sequence
  Synthetic
gccaagcatttaggtgacactatagggatgactgctagtctcgctgtttcagagctatgctggaaacagc

SEQ ID NO: 61457 - DNA, 70 bp, Artificial Sequence
  Synthetic
gccaagcatttaggtgacactatagtctaatgaccgactgggctcgtttcagagctatgctggaaacagc

SEQ ID NO: 61458 - DNA, 70 bp, Artificial Sequence
  Synthetic
gccaagcatttaggtgacactataggccaggcagttactcctgaggtttcagagctatgctggaaacagc

SEQ ID NO: 61459 - DNA, 70 bp, Artificial Sequence
  Synthetic
gccaagcatttaggtgacactatagctttgcctccagtggacgatgtttcagagctatgctggaaacagc

SEQ ID NO: 61460 - DNA, 70 bp, Artificial Sequence
  Synthetic
gccaagcatttaggtgacactatagtgacaatataacagtcatgggtttcagagctatgctggaaacagc

SEQ ID NO: 61461 - DNA, 70 bp, Artificial Sequence
  Synthetic
gccaagcatttaggtgacactatagtacagtgtctgaatcctcaggtttcagagctatgctggaaacagc

SEQ ID NO: 61462 - DNA, 70 bp, Artificial Sequence
  Synthetic
gccaagcatttaggtgacactataggggctcagccttggacatgggtttcagagctatgctggaaacagc

SEQ ID NO: 61463 - DNA, 70 bp, Artificial Sequence
  Synthetic
gccaagcatttaggtgacactatagacagcaggtcactaacagccgtttcagagctatgctggaaacagc

SEQ ID NO: 61464 - DNA, 70 bp, Artificial Sequence
  Synthetic
gccaagcatttaggtgacactatagagagttggggatcagctgttgtttcagagctatgctggaaacagc

SEQ ID NO: 61465 - DNA, 70 bp, Artificial Sequence
  Synthetic
gccaagcatttaggtgacactatagggtgtgcgggggctatttctgtttcagagctatgctggaaacagc

SEQ ID NO: 61466 - DNA, 70 bp, Artificial Sequence
  Synthetic
gccaagcatttaggtgacactatagcagctaatccgccgaagaaagtttcagagctatgctggaaacagc

SEQ ID NO: 61467 - DNA, 70 bp, Artificial Sequence
  Synthetic
gccaagcatttaggtgacactatagtgctttgtgatcatacccctgtttcagagctatgctggaaacagc

SEQ ID NO: 61468 - DNA, 70 bp, Artificial Sequence
  Synthetic
gccaagcatttaggtgacactatagtttgaagctttctgaatggagtttcagagctatgctggaaacagc

SEQ ID NO: 61469 - DNA, 70 bp, Artificial Sequence
  Synthetic
gccaagcatttaggtgacactatagaatgggccccccctgccctagtttcagagctatgctggaaacagc

SEQ ID NO: 61470 - DNA, 70 bp, Artificial Sequence
  Synthetic
gccaagcatttaggtgacactatagagagggatttagtgctgcatgtttcagagctatgctggaaacagc

SEQ ID NO: 61471 - DNA, 70 bp, Artificial Sequence
  Synthetic
gccaagcatttaggtgacactataggaggctaaaggatgaaaatggtttcagagctatgctggaaacagc

SEQ ID NO: 61472 - DNA, 70 bp, Artificial Sequence
  Synthetic
gccaagcatttaggtgacactataggagggtatgggggaattccagtttcagagctatgctggaaacagc

SEQ ID NO: 61473 - DNA, 70 bp, Artificial Sequence
  Synthetic
gccaagcatttaggtgacactatagaatctggagcctagcctactgtttcagagctatgctggaaacagc

SEQ ID NO: 61474 - DNA, 70 bp, Artificial Sequence
  Synthetic
gccaagcatttaggtgacactataggctcttctggcttgttaaaagtttcagagctatgctggaaacagc

SEQ ID NO: 61475 - DNA, 70 bp, Artificial Sequence
  Synthetic
gccaagcatttaggtgacactatagggggcaagaactagagctccgtttcagagctatgctggaaacagc

SEQ ID NO: 61476 - DNA, 70 bp, Artificial Sequence
  Synthetic
gccaagcatttaggtgacactatagagcaaactctccaagtgaccgtttcagagctatgctggaaacagc

SEQ ID NO: 61477 - DNA, 70 bp, Artificial Sequence
  Synthetic
gccaagcatttaggtgacactatagttcaggcgagtgttcgctgtgtttcagagctatgctggaaacagc

SEQ ID NO: 61478 - DNA, 70 bp, Artificial Sequence
  Synthetic
gccaagcatttaggtgacactatagtcaaaggagtaaagtctagcgtttcagagctatgctggaaacagc

SEQ ID NO: 61479 - DNA, 70 bp, Artificial Sequence
  Synthetic
gccaagcatttaggtgacactatagggagagtgcaagagggtcaggtttcagagctatgctggaaacagc

SEQ ID NO: 61480 - DNA, 70 bp, Artificial Sequence
  Synthetic
gccaagcatttaggtgacactatagaatcatacactcttcttctggtttcagagctatgctggaaacagc

SEQ ID NO: 61481 - DNA, 70 bp, Artificial Sequence
  Synthetic
gccaagcatttaggtgacactatagaggatctggagtttcagggcgtttcagagctatgctggaaacagc

SEQ ID NO: 61482 - DNA, 70 bp, Artificial Sequence
  Synthetic
gccaagcatttaggtgacactataggtctctcaggcttatttctggtttcagagctatgctggaaacagc

SEQ ID NO: 61483 - DNA, 70 bp, Artificial Sequence
  Synthetic
gccaagcatttaggtgacactatagctggacctcagtgggaggcggtttcagagctatgctggaaacagc

SEQ ID NO: 61484 - DNA, 70 bp, Artificial Sequence
  Synthetic
gccaagcatttaggtgacactataggttctcaagcaatgttgagtgtttcagagctatgctggaaacagc

SEQ ID NO: 61485 - DNA, 70 bp, Artificial Sequence
  Synthetic
gccaagcatttaggtgacactatagccgtgctgcctgctcatgtggtttcagagctatgctggaaacagc

SEQ ID NO: 61486 - DNA, 70 bp, Artificial Sequence
  Synthetic
gccaagcatttaggtgacactatagcacacggagactaggagatagtttcagagctatgctggaaacagc

SEQ ID NO: 61487 - DNA, 70 bp, Artificial Sequence
  Synthetic
gccaagcatttaggtgacactataggtggaagatgacgaaaaggagtttcagagctatgctggaaacagc

SEQ ID NO: 61488 - DNA, 70 bp, Artificial Sequence
  Synthetic
gccaagcatttaggtgacactatagtgttggaagatggtcaccgcgtttcagagctatgctggaaacagc

SEQ ID NO: 61489 - DNA, 70 bp, Artificial Sequence
  Synthetic
gccaagcatttaggtgacactatagggattccaagggagccaactgtttcagagctatgctggaaacagc

SEQ ID NO: 61490 - DNA, 70 bp, Artificial Sequence
  Synthetic
gccaagcatttaggtgacactatagcccctctgagcctggcacatgtttcagagctatgctggaaacagc

SEQ ID NO: 61491 - DNA, 70 bp, Artificial Sequence
  Synthetic
gccaagcatttaggtgacactatagcaatgaaagagaggagcagcgtttcagagctatgctggaaacagc

SEQ ID NO: 61492 - DNA, 70 bp, Artificial Sequence
  Synthetic
gccaagcatttaggtgacactatagtgctgcagaccagtaattaagtttcagagctatgctggaaacagc

SEQ ID NO: 61493 - DNA, 70 bp, Artificial Sequence
  Synthetic
gccaagcatttaggtgacactatagttgttttgctgttggtcactgtttcagagctatgctggaaacagc

SEQ ID NO: 61494 - DNA, 70 bp, Artificial Sequence
  Synthetic
gccaagcatttaggtgacactatagcacactaaagatgtccagtagtttcagagctatgctggaaacagc

SEQ ID NO: 61495 - DNA, 70 bp, Artificial Sequence
  Synthetic
gccaagcatttaggtgacactatagtggcggcagctcagtagtgagtttcagagctatgctggaaacagc

SEQ ID NO: 61496 - DNA, 70 bp, Artificial Sequence
  Synthetic
gccaagcatttaggtgacactatagaaagctggctcagtccatcggtttcagagctatgctggaaacagc

SEQ ID NO: 61497 - DNA, 70 bp, Artificial Sequence
  Synthetic
gccaagcatttaggtgacactataggtgaagcaggcatcttctaagtttcagagctatgctggaaacagc

SEQ ID NO: 61498 - DNA, 70 bp, Artificial Sequence
  Synthetic
gccaagcatttaggtgacactatagctcagctgtgtgccacgcaggtttcagagctatgctggaaacagc

SEQ ID NO: 61499 - DNA, 70 bp, Artificial Sequence
  Synthetic
gccaagcatttaggtgacactataggcaccggacactgaggcgatgtttcagagctatgctggaaacagc

SEQ ID NO: 61500 - DNA, 70 bp, Artificial Sequence
  Synthetic
gccaagcatttaggtgacactatagcgtttctgggtcacacaagagtttcagagctatgctggaaacagc

SEQ ID NO: 61501 - DNA, 70 bp, Artificial Sequence
  Synthetic
gccaagcatttaggtgacactatagacatcatgccctaagtaaccgtttcagagctatgctggaaacagc

SEQ ID NO: 61502 - DNA, 70 bp, Artificial Sequence
  Synthetic
gccaagcatttaggtgacactataggtgtcacagtgtctcctgccgtttcagagctatgctggaaacagc

SEQ ID NO: 61503 - DNA, 70 bp, Artificial Sequence
  Synthetic
gccaagcatttaggtgacactatagtcctggctatcctgggaagagtttcagagctatgctggaaacagc

SEQ ID NO: 61504 - DNA, 70 bp, Artificial Sequence
  Synthetic
gccaagcatttaggtgacactatagcacctgcagtcactagtagtgtttcagagctatgctggaaacagc

SEQ ID NO: 61505 - DNA, 70 bp, Artificial Sequence
  Synthetic
gccaagcatttaggtgacactatagctgggggagaatggagaactgtttcagagctatgctggaaacagc

SEQ ID NO: 61506 - DNA, 70 bp, Artificial Sequence
  Synthetic
gccaagcatttaggtgacactatagcccgcgcggctcagatgaaggtttcagagctatgctggaaacagc

SEQ ID NO: 61507 - DNA, 70 bp, Artificial Sequence
  Synthetic
gccaagcatttaggtgacactataggcgcctcgtctcagataaaggtttcagagctatgctggaaacagc

SEQ ID NO: 61508 - DNA, 70 bp, Artificial Sequence
  Synthetic
gccaagcatttaggtgacactatagctctctggcttggttctcatgtttcagagctatgctggaaacagc

SEQ ID NO: 61509 - DNA, 70 bp, Artificial Sequence
  Synthetic
gccaagcatttaggtgacactatagcaggctcagagcgcgtccgcgtttcagagctatgctggaaacagc

SEQ ID NO: 61510 - DNA, 70 bp, Artificial Sequence
  Synthetic
gccaagcatttaggtgacactatagatattggtgtccaaatcactgtttcagagctatgctggaaacagc

SEQ ID NO: 61511 - DNA, 70 bp, Artificial Sequence
  Synthetic
gccaagcatttaggtgacactatagcaaccaacttctgcatgtgagtttcagagctatgctggaaacagc

SEQ ID NO: 61512 - DNA, 70 bp, Artificial Sequence
  Synthetic
gccaagcatttaggtgacactatagagatcgatgccacgttcgtcgtttcagagctatgctggaaacagc

SEQ ID NO: 61513 - DNA, 70 bp, Artificial Sequence
  Synthetic
gccaagcatttaggtgacactatagggacagcctcacgtactgaggtttcagagctatgctggaaacagc

SEQ ID NO: 61514 - DNA, 70 bp, Artificial Sequence
  Synthetic
gccaagcatttaggtgacactatagtcaaatcagcaaggaaggtggtttcagagctatgctggaaacagc

SEQ ID NO: 61515 - DNA, 70 bp, Artificial Sequence
  Synthetic
gccaagcatttaggtgacactatagtcaactacagccgagggtgcgtttcagagctatgctggaaacagc

SEQ ID NO: 61516 - DNA, 70 bp, Artificial Sequence
  Synthetic
gccaagcatttaggtgacactatagaaggaaacttgcaaacactggtttcagagctatgctggaaacagc

SEQ ID NO: 61517 - DNA, 70 bp, Artificial Sequence
  Synthetic
gccaagcatttaggtgacactatagtttcattacaggaagtagtcgtttcagagctatgctggaaacagc

SEQ ID NO: 61518 - DNA, 70 bp, Artificial Sequence
  Synthetic
gccaagcatttaggtgacactataggtggtgagcctcatgttacagtttcagagctatgctggaaacagc

SEQ ID NO: 61519 - DNA, 70 bp, Artificial Sequence
  Synthetic
gccaagcatttaggtgacactatagcgtcaaatactttgcccagggtttcagagctatgctggaaacagc

SEQ ID NO: 61520 - DNA, 70 bp, Artificial Sequence
  Synthetic
gccaagcatttaggtgacactataggttcttgcattggcataatggtttcagagctatgctggaaacagc

SEQ ID NO: 61521 - DNA, 70 bp, Artificial Sequence
  Synthetic
gccaagcatttaggtgacactatagtggggtattagtctgtgcttgtttcagagctatgctggaaacagc

SEQ ID NO: 61522 - DNA, 70 bp, Artificial Sequence
  Synthetic
gccaagcatttaggtgacactatagtacggcaatgatattttcctgtttcagagctatgctggaaacagc

SEQ ID NO: 61523 - DNA, 70 bp, Artificial Sequence
  Synthetic
gccaagcatttaggtgacactatagccaggacaaggttaactagggtttcagagctatgctggaaacagc

SEQ ID NO: 61524 - DNA, 70 bp, Artificial Sequence
  Synthetic
gccaagcatttaggtgacactatagggtaaactctgacatgcactgtttcagagctatgctggaaacagc

SEQ ID NO: 61525 - DNA, 70 bp, Artificial Sequence
  Synthetic
gccaagcatttaggtgacactataggtctctagttgattttgtccgtttcagagctatgctggaaacagc

SEQ ID NO: 61526 - DNA, 70 bp, Artificial Sequence
  Synthetic
gccaagcatttaggtgacactatagatgtggaaagcttcaatcaggtttcagagctatgctggaaacagc

SEQ ID NO: 61527 - DNA, 70 bp, Artificial Sequence
  Synthetic
gccaagcatttaggtgacactatagtctcgcgggcggcgtcacaggtttcagagctatgctggaaacagc

SEQ ID NO: 61528 - DNA, 70 bp, Artificial Sequence
  Synthetic
gccaagcatttaggtgacactatagtcagagatcatgtatcatcagtttcagagctatgctggaaacagc

SEQ ID NO: 61529 - DNA, 70 bp, Artificial Sequence
  Synthetic
gccaagcatttaggtgacactatagcagctttgtatgagctagtagtttcagagctatgctggaaacagc

SEQ ID NO: 61530 - DNA, 70 bp, Artificial Sequence
  Synthetic
gccaagcatttaggtgacactatagtgtctagctctgacccccacgtttcagagctatgctggaaacagc

SEQ ID NO: 61531 - DNA, 70 bp, Artificial Sequence
  Synthetic
gccaagcatttaggtgacactatagtctagccaaagccaatccccgtttcagagctatgctggaaacagc

SEQ ID NO: 61532 - DNA, 70 bp, Artificial Sequence
  Synthetic
gccaagcatttaggtgacactatagcgcggcgccccggaggctaggtttcagagctatgctggaaacagc

SEQ ID NO: 61533 - DNA, 70 bp, Artificial Sequence
  Synthetic
gccaagcatttaggtgacactatagtgaggggtcagagagcctccgtttcagagctatgctggaaacagc

SEQ ID NO: 61534 - DNA, 70 bp, Artificial Sequence
  Synthetic
gccaagcatttaggtgacactatagaagagaggtcttagacgtgagtttcagagctatgctggaaacagc

SEQ ID NO: 61535 - DNA, 70 bp, Artificial Sequence
  Synthetic
gccaagcatttaggtgacactatagactaacggcacggacagcaagtttcagagctatgctggaaacagc

SEQ ID NO: 61536 - DNA, 70 bp, Artificial Sequence
  Synthetic
gccaagcatttaggtgacactatagcctgggaagtagtgggtcacgtttcagagctatgctggaaacagc

SEQ ID NO: 61537 - DNA, 70 bp, Artificial Sequence
  Synthetic
gccaagcatttaggtgacactatagtctaggtcagctgctgagacgtttcagagctatgctggaaacagc

SEQ ID NO: 61538 - DNA, 70 bp, Artificial Sequence
  Synthetic
gccaagcatttaggtgacactataggcaggactctaagtcatgaagtttcagagctatgctggaaacagc

SEQ ID NO: 61539 - DNA, 70 bp, Artificial Sequence
  Synthetic
gccaagcatttaggtgacactatagagatatccacaaaaagatgggtttcagagctatgctggaaacagc

SEQ ID NO: 61540 - DNA, 70 bp, Artificial Sequence
  Synthetic
gccaagcatttaggtgacactatagagaaaaaggctcatacgatggtttcagagctatgctggaaacagc

SEQ ID NO: 61541 - DNA, 70 bp, Artificial Sequence
  Synthetic
gccaagcatttaggtgacactatagcaggggccgggcggggtcacgtttcagagctatgctggaaacagc

SEQ ID NO: 61542 - DNA, 70 bp, Artificial Sequence
  Synthetic
gccaagcatttaggtgacactatagagcgtcctcaacctactagagtttcagagctatgctggaaacagc

SEQ ID NO: 61543 - DNA, 70 bp, Artificial Sequence
  Synthetic
gccaagcatttaggtgacactatagagaagtcaccgatgaaccaagtttcagagctatgctggaaacagc

SEQ ID NO: 61544 - DNA, 70 bp, Artificial Sequence
  Synthetic
gccaagcatttaggtgacactatagcctcaacttcccaaactgcggtttcagagctatgctggaaacagc

SEQ ID NO: 61545 - DNA, 70 bp, Artificial Sequence
  Synthetic
gccaagcatttaggtgacactatagtgatgatgaggatgaagatagtttcagagctatgctggaaacagc

SEQ ID NO: 61546 - DNA, 70 bp, Artificial Sequence
  Synthetic
gccaagcatttaggtgacactatagatattttatgagccaagacggtttcagagctatgctggaaacagc

SEQ ID NO: 61547 - DNA, 70 bp, Artificial Sequence
  Synthetic
gccaagcatttaggtgacactatagagattttaggagctaagatggtttcagagctatgctggaaacagc

SEQ ID NO: 61548 - DNA, 70 bp, Artificial Sequence
  Synthetic
gccaagcatttaggtgacactatagccaaatcctgataagacttggtttcagagctatgctggaaacagc

SEQ ID NO: 61549 - DNA, 70 bp, Artificial Sequence
  Synthetic
gccaagcatttaggtgacactatagctccacagagtcacaccctcgtttcagagctatgctggaaacagc

SEQ ID NO: 61550 - DNA, 70 bp, Artificial Sequence
  Synthetic
gccaagcatttaggtgacactatagtaaagatacacaaccacggagtttcagagctatgctggaaacagc

SEQ ID NO: 61551 - DNA, 70 bp, Artificial Sequence
  Synthetic
gccaagcatttaggtgacactatagctgcagctaggaatgatgtggtttcagagctatgctggaaacagc

SEQ ID NO: 61552 - DNA, 70 bp, Artificial Sequence
  Synthetic
gccaagcatttaggtgacactatagggtgcctggaagacgtcacggtttcagagctatgctggaaacagc

SEQ ID NO: 61553 - DNA, 70 bp, Artificial Sequence
  Synthetic
gccaagcatttaggtgacactatagaggatgggcgaaggcctcaagtttcagagctatgctggaaacagc

SEQ ID NO: 61554 - DNA, 70 bp, Artificial Sequence
  Synthetic
gccaagcatttaggtgacactatagccggaagggcctgcatccccgtttcagagctatgctggaaacagc

SEQ ID NO: 61555 - DNA, 70 bp, Artificial Sequence
  Synthetic
gccaagcatttaggtgacactatagccagaaggagctgccttaaagtttcagagctatgctggaaacagc

SEQ ID NO: 61556 - DNA, 70 bp, Artificial Sequence
  Synthetic
gccaagcatttaggtgacactataggggcggcagcagcatcacacgtttcagagctatgctggaaacagc

SEQ ID NO: 61557 - DNA, 70 bp, Artificial Sequence
  Synthetic
gccaagcatttaggtgacactatagagtgaatggccctgtatgacgtttcagagctatgctggaaacagc

SEQ ID NO: 61558 - DNA, 70 bp, Artificial Sequence
  Synthetic
gccaagcatttaggtgacactatagttccagcactcccaggacaggtttcagagctatgctggaaacagc

SEQ ID NO: 61559 - DNA, 70 bp, Artificial Sequence
  Synthetic
gccaagcatttaggtgacactataggggcccaaggttacctcctggtttcagagctatgctggaaacagc

SEQ ID NO: 61560 - DNA, 70 bp, Artificial Sequence
  Synthetic
gccaagcatttaggtgacactatagaactatacgggtttcatccagtttcagagctatgctggaaacagc

SEQ ID NO: 61561 - DNA, 70 bp, Artificial Sequence
  Synthetic
gccaagcatttaggtgacactatagattgaaccttggctctcctggtttcagagctatgctggaaacagc

SEQ ID NO: 61562 - DNA, 70 bp, Artificial Sequence
  Synthetic
gccaagcatttaggtgacactatagcaccgtccttctttcaataggtttcagagctatgctggaaacagc

SEQ ID NO: 61563 - DNA, 70 bp, Artificial Sequence
  Synthetic
gccaagcatttaggtgacactatagtatgatgctgacatcctcatgtttcagagctatgctggaaacagc

SEQ ID NO: 61564 - DNA, 70 bp, Artificial Sequence
  Synthetic
gccaagcatttaggtgacactatagaggtggcattataagtccaggtttcagagctatgctggaaacagc

SEQ ID NO: 61565 - DNA, 70 bp, Artificial Sequence
  Synthetic
gccaagcatttaggtgacactatagggcctcccgaaccaagcagcgtttcagagctatgctggaaacagc

SEQ ID NO: 61566 - DNA, 70 bp, Artificial Sequence
  Synthetic
gccaagcatttaggtgacactatagacggcctacttcctgctgaagtttcagagctatgctggaaacagc

SEQ ID NO: 61567 - DNA, 70 bp, Artificial Sequence
  Synthetic
gccaagcatttaggtgacactatagctcgtcctccccactgtcaggtttcagagctatgctggaaacagc

SEQ ID NO: 61568 - DNA, 70 bp, Artificial Sequence
  Synthetic
gccaagcatttaggtgacactatagtcagcctggttctggtcagcgtttcagagctatgctggaaacagc

SEQ ID NO: 61569 - DNA, 70 bp, Artificial Sequence
  Synthetic
gccaagcatttaggtgacactatagatgggatatatacagggcaggtttcagagctatgctggaaacagc

SEQ ID NO: 61570 - DNA, 70 bp, Artificial Sequence
  Synthetic
gccaagcatttaggtgacactataggaataggcagttggttagtcgtttcagagctatgctggaaacagc

SEQ ID NO: 61571 - DNA, 70 bp, Artificial Sequence
  Synthetic
gccaagcatttaggtgacactatagtaagtgaaattagcatgcctgtttcagagctatgctggaaacagc

SEQ ID NO: 61572 - DNA, 70 bp, Artificial Sequence
  Synthetic
gccaagcatttaggtgacactatagtgtttgcattggccatgattgtttcagagctatgctggaaacagc

SEQ ID NO: 61573 - DNA, 70 bp, Artificial Sequence
  Synthetic
gccaagcatttaggtgacactatagccgctataaaggctgaatgagtttcagagctatgctggaaacagc

SEQ ID NO: 61574 - DNA, 70 bp, Artificial Sequence
  Synthetic
gccaagcatttaggtgacactatagcttctggctcagattcagaagtttcagagctatgctggaaacagc

SEQ ID NO: 61575 - DNA, 70 bp, Artificial Sequence
  Synthetic
gccaagcatttaggtgacactataggcagaagtggatcatagaccgtttcagagctatgctggaaacagc

SEQ ID NO: 61576 - DNA, 70 bp, Artificial Sequence
  Synthetic
gccaagcatttaggtgacactataggaatttcgggaggccgaggcgtttcagagctatgctggaaacagc

SEQ ID NO: 61577 - DNA, 70 bp, Artificial Sequence
  Synthetic
gccaagcatttaggtgacactatagcgacagaggctcaccactccgtttcagagctatgctggaaacagc

SEQ ID NO: 61578 - DNA, 70 bp, Artificial Sequence
  Synthetic
gccaagcatttaggtgacactatagggacaaactcttctaccagagtttcagagctatgctggaaacagc

SEQ ID NO: 61579 - DNA, 70 bp, Artificial Sequence
  Synthetic
gccaagcatttaggtgacactatagagagcaggaggctggatcctgtttcagagctatgctggaaacagc

SEQ ID NO: 61580 - DNA, 70 bp, Artificial Sequence
  Synthetic
gccaagcatttaggtgacactataggcttggctcacagaagctgcgtttcagagctatgctggaaacagc

SEQ ID NO: 61581 - DNA, 70 bp, Artificial Sequence
  Synthetic
gccaagcatttaggtgacactatagcctaccggtcttaccgtcccgtttcagagctatgctggaaacagc

SEQ ID NO: 61582 - DNA, 70 bp, Artificial Sequence
  Synthetic
gccaagcatttaggtgacactatagtgtttcatgcctaattagctgtttcagagctatgctggaaacagc

SEQ ID NO: 61583 - DNA, 70 bp, Artificial Sequence
  Synthetic
gccaagcatttaggtgacactataggagctccatctttgctgctagtttcagagctatgctggaaacagc

SEQ ID NO: 61584 - DNA, 70 bp, Artificial Sequence
  Synthetic
gccaagcatttaggtgacactataggacttccatctttgctcctagtttcagagctatgctggaaacagc

SEQ ID NO: 61585 - DNA, 70 bp, Artificial Sequence
  Synthetic
gccaagcatttaggtgacactatagttgaatgcctgctgtcaggggtttcagagctatgctggaaacagc

SEQ ID NO: 61586 - DNA, 70 bp, Artificial Sequence
  Synthetic
gccaagcatttaggtgacactataggccttcactaagagcaaagagtttcagagctatgctggaaacagc

SEQ ID NO: 61587 - DNA, 70 bp, Artificial Sequence
  Synthetic
gccaagcatttaggtgacactatagtggggaaggcctgcctagtggtttcagagctatgctggaaacagc

SEQ ID NO: 61588 - DNA, 70 bp, Artificial Sequence
  Synthetic
gccaagcatttaggtgacactatagcggggaaggcctgcctagtggtttcagagctatgctggaaacagc

SEQ ID NO: 61589 - DNA, 70 bp, Artificial Sequence
  Synthetic
gccaagcatttaggtgacactatagtttacgacctggaggtagatgtttcagagctatgctggaaacagc

SEQ ID NO: 61590 - DNA, 70 bp, Artificial Sequence
  Synthetic
gccaagcatttaggtgacactatagtcaatttttgcttgtggggagtttcagagctatgctggaaacagc

SEQ ID NO: 61591 - DNA, 70 bp, Artificial Sequence
  Synthetic
gccaagcatttaggtgacactatagagcagtattgatctgcctccgtttcagagctatgctggaaacagc

SEQ ID NO: 61592 - DNA, 70 bp, Artificial Sequence
  Synthetic
gccaagcatttaggtgacactatagagcagcattgatctgcctccgtttcagagctatgctggaaacagc

SEQ ID NO: 61593 - DNA, 70 bp, Artificial Sequence
  Synthetic
gccaagcatttaggtgacactatagtgatggcaggcattcaacaggtttcagagctatgctggaaacagc

SEQ ID NO: 61594 - DNA, 70 bp, Artificial Sequence
  Synthetic
gccaagcatttaggtgacactataggatggcccctggagccctacgtttcagagctatgctggaaacagc

SEQ ID NO: 61595 - DNA, 70 bp, Artificial Sequence
  Synthetic
gccaagcatttaggtgacactatagatgactggggaggctgtcacgtttcagagctatgctggaaacagc

SEQ ID NO: 61596 - DNA, 70 bp, Artificial Sequence
  Synthetic
gccaagcatttaggtgacactatagtgtcattgaaccttgattacgtttcagagctatgctggaaacagc

SEQ ID NO: 61597 - DNA, 70 bp, Artificial Sequence
  Synthetic
gccaagcatttaggtgacactatagtgaatcctagattactgggggtttcagagctatgctggaaacagc

SEQ ID NO: 61598 - DNA, 70 bp, Artificial Sequence
  Synthetic
gccaagcatttaggtgacactatagtccagaagtagcatcagattgtttcagagctatgctggaaacagc

SEQ ID NO: 61599 - DNA, 70 bp, Artificial Sequence
  Synthetic
gccaagcatttaggtgacactatagtgatcagggcttctcaggacgtttcagagctatgctggaaacagc

SEQ ID NO: 61600 - DNA, 70 bp, Artificial Sequence
  Synthetic
gccaagcatttaggtgacactatagccaagccaaatatggattctgtttcagagctatgctggaaacagc

SEQ ID NO: 61601 - DNA, 70 bp, Artificial Sequence
  Synthetic
gccaagcatttaggtgacactataggcaagggtggacctttaaatgtttcagagctatgctggaaacagc

SEQ ID NO: 61602 - DNA, 70 bp, Artificial Sequence
  Synthetic
gccaagcatttaggtgacactatagagagatttctatgacagtgcgtttcagagctatgctggaaacagc

SEQ ID NO: 61603 - DNA, 70 bp, Artificial Sequence
  Synthetic
gccaagcatttaggtgacactatagacaagaaacagttgaaccaagtttcagagctatgctggaaacagc

SEQ ID NO: 61604 - DNA, 70 bp, Artificial Sequence
  Synthetic
gccaagcatttaggtgacactatagccagggtggaagtcatggttgtttcagagctatgctggaaacagc

SEQ ID NO: 61605 - DNA, 70 bp, Artificial Sequence
  Synthetic
gccaagcatttaggtgacactataggagttttaccccgacatttagtttcagagctatgctggaaacagc

SEQ ID NO: 61606 - DNA, 70 bp, Artificial Sequence
  Synthetic
gccaagcatttaggtgacactatagtacgcagtgggctgtgtggagtttcagagctatgctggaaacagc

SEQ ID NO: 61607 - DNA, 70 bp, Artificial Sequence
  Synthetic
gccaagcatttaggtgacactatagcgggcgcgctcacagcaccagtttcagagctatgctggaaacagc

SEQ ID NO: 61608 - DNA, 70 bp, Artificial Sequence
  Synthetic
gccaagcatttaggtgacactatagccccgaggttgggggcggcggtttcagagctatgctggaaacagc

SEQ ID NO: 61609 - DNA, 70 bp, Artificial Sequence
  Synthetic
gccaagcatttaggtgacactatagagtcttcatgaaacttcatggtttcagagctatgctggaaacagc

SEQ ID NO: 61610 - DNA, 70 bp, Artificial Sequence
  Synthetic
gccaagcatttaggtgacactatagggcccagccccaggtgcagggtttcagagctatgctggaaacagc

SEQ ID NO: 61611 - DNA, 70 bp, Artificial Sequence
  Synthetic
gccaagcatttaggtgacactatagccggctgcccagcccgtcaggtttcagagctatgctggaaacagc

SEQ ID NO: 61612 - DNA, 70 bp, Artificial Sequence
  Synthetic
gccaagcatttaggtgacactatagagtgtctactctttgaagaagtttcagagctatgctggaaacagc

SEQ ID NO: 61613 - DNA, 70 bp, Artificial Sequence
  Synthetic
gccaagcatttaggtgacactatagcctttggcttcactgattccgtttcagagctatgctggaaacagc

SEQ ID NO: 61614 - DNA, 70 bp, Artificial Sequence
  Synthetic
gccaagcatttaggtgacactatagtgttttgggggcttttctacgtttcagagctatgctggaaacagc

SEQ ID NO: 61615 - DNA, 70 bp, Artificial Sequence
  Synthetic
gccaagcatttaggtgacactatagtaacagtgctgtgtattcaggtttcagagctatgctggaaacagc

SEQ ID NO: 61616 - DNA, 70 bp, Artificial Sequence
  Synthetic
gccaagcatttaggtgacactatagggtgtagctgacagctaatagtttcagagctatgctggaaacagc

SEQ ID NO: 61617 - DNA, 70 bp, Artificial Sequence
  Synthetic
gccaagcatttaggtgacactataggcgtcctcttgtgctcatccgtttcagagctatgctggaaacagc

SEQ ID NO: 61618 - DNA, 70 bp, Artificial Sequence
  Synthetic
gccaagcatttaggtgacactataggagcccagaatcaatcgaaggtttcagagctatgctggaaacagc

SEQ ID NO: 61619 - DNA, 70 bp, Artificial Sequence
  Synthetic
gccaagcatttaggtgacactatagaaggtcaagagatcaaagaagtttcagagctatgctggaaacagc

SEQ ID NO: 61620 - DNA, 70 bp, Artificial Sequence
  Synthetic
gccaagcatttaggtgacactatagatgacctcgcataattgactgtttcagagctatgctggaaacagc

SEQ ID NO: 61621 - DNA, 70 bp, Artificial Sequence
  Synthetic
gccaagcatttaggtgacactataggaagccctacgtctgcaggggtttcagagctatgctggaaacagc

SEQ ID NO: 61622 - DNA, 70 bp, Artificial Sequence
  Synthetic
gccaagcatttaggtgacactataggcccagcgctcacttctgctgtttcagagctatgctggaaacagc

SEQ ID NO: 61623 - DNA, 70 bp, Artificial Sequence
  Synthetic
gccaagcatttaggtgacactatagttctccaaacacaattaggcgtttcagagctatgctggaaacagc

SEQ ID NO: 61624 - DNA, 70 bp, Artificial Sequence
  Synthetic
gccaagcatttaggtgacactatagttccaaagagtactttcagagtttcagagctatgctggaaacagc

SEQ ID NO: 61625 - DNA, 70 bp, Artificial Sequence
  Synthetic
gccaagcatttaggtgacactatagaaatacttcagctttccagcgtttcagagctatgctggaaacagc

SEQ ID NO: 61626 - DNA, 70 bp, Artificial Sequence
  Synthetic
gccaagcatttaggtgacactatagaatatcatctcacagctctggtttcagagctatgctggaaacagc

SEQ ID NO: 61627 - DNA, 70 bp, Artificial Sequence
  Synthetic
gccaagcatttaggtgacactatagttctccaagagacttaaggcgtttcagagctatgctggaaacagc

SEQ ID NO: 61628 - DNA, 70 bp, Artificial Sequence
  Synthetic
gccaagcatttaggtgacactatagccaggaagcagggaagctaagtttcagagctatgctggaaacagc

SEQ ID NO: 61629 - DNA, 70 bp, Artificial Sequence
  Synthetic
gccaagcatttaggtgacactatagtcctgctcctgctgtgtgtcgtttcagagctatgctggaaacagc

SEQ ID NO: 61630 - DNA, 70 bp, Artificial Sequence
  Synthetic
gccaagcatttaggtgacactatagttgctgctgctgctgcttctgtttcagagctatgctggaaacagc

SEQ ID NO: 61631 - DNA, 70 bp, Artificial Sequence
  Synthetic
gccaagcatttaggtgacactatagatgctgctaaaggaacagtggtttcagagctatgctggaaacagc

SEQ ID NO: 61632 - DNA, 70 bp, Artificial Sequence
  Synthetic
gccaagcatttaggtgacactataggaaagcgctgtgagctaagggtttcagagctatgctggaaacagc

SEQ ID NO: 61633 - DNA, 70 bp, Artificial Sequence
  Synthetic
gccaagcatttaggtgacactataggcaaacgctgctgctgccatgtttcagagctatgctggaaacagc

SEQ ID NO: 61634 - DNA, 70 bp, Artificial Sequence
  Synthetic
gccaagcatttaggtgacactatagcctgcagtccgtggtcatctgtttcagagctatgctggaaacagc

SEQ ID NO: 61635 - DNA, 70 bp, Artificial Sequence
  Synthetic
gccaagcatttaggtgacactatagcgcggtgcctgaacgtcgacgtttcagagctatgctggaaacagc

SEQ ID NO: 61636 - DNA, 70 bp, Artificial Sequence
  Synthetic
gccaagcatttaggtgacactatagatgcagtgtttcagaatttcgtttcagagctatgctggaaacagc

SEQ ID NO: 61637 - DNA, 70 bp, Artificial Sequence
  Synthetic
gccaagcatttaggtgacactatagtggggcatttgggtgttcaggtttcagagctatgctggaaacagc

SEQ ID NO: 61638 - DNA, 70 bp, Artificial Sequence
  Synthetic
gccaagcatttaggtgacactatagccaaagggtaagaatcagacgtttcagagctatgctggaaacagc

SEQ ID NO: 61639 - DNA, 70 bp, Artificial Sequence
  Synthetic
gccaagcatttaggtgacactatagtcttttcattcttctccagcgtttcagagctatgctggaaacagc

SEQ ID NO: 61640 - DNA, 70 bp, Artificial Sequence
  Synthetic
gccaagcatttaggtgacactatagagctcactgttctcaccacagtttcagagctatgctggaaacagc

SEQ ID NO: 61641 - DNA, 70 bp, Artificial Sequence
  Synthetic
gccaagcatttaggtgacactatagttcatctgttcctactgagcgtttcagagctatgctggaaacagc

SEQ ID NO: 61642 - DNA, 70 bp, Artificial Sequence
  Synthetic
gccaagcatttaggtgacactatagctccgtgccgctggcttagagtttcagagctatgctggaaacagc

SEQ ID NO: 61643 - DNA, 70 bp, Artificial Sequence
  Synthetic
gccaagcatttaggtgacactatagaggacagttgtaccagacttgtttcagagctatgctggaaacagc

SEQ ID NO: 61644 - DNA, 70 bp, Artificial Sequence
  Synthetic
gccaagcatttaggtgacactatagtactgaggagactgcccctggtttcagagctatgctggaaacagc

SEQ ID NO: 61645 - DNA, 70 bp, Artificial Sequence
  Synthetic
gccaagcatttaggtgacactatagaagaagaaaaagggacacaagtttcagagctatgctggaaacagc

SEQ ID NO: 61646 - DNA, 70 bp, Artificial Sequence
  Synthetic
gccaagcatttaggtgacactataggcagaggacagttgcacagcgtttcagagctatgctggaaacagc

SEQ ID NO: 61647 - DNA, 70 bp, Artificial Sequence
  Synthetic
gccaagcatttaggtgacactatagagaactgcatcgtggcttgagtttcagagctatgctggaaacagc

SEQ ID NO: 61648 - DNA, 70 bp, Artificial Sequence
  Synthetic
gccaagcatttaggtgacactatagcgcactgcaccatgtgctaggtttcagagctatgctggaaacagc

SEQ ID NO: 61649 - DNA, 70 bp, Artificial Sequence
  Synthetic
gccaagcatttaggtgacactatagaatctggataaatcccgaaagtttcagagctatgctggaaacagc

SEQ ID NO: 61650 - DNA, 70 bp, Artificial Sequence
  Synthetic
gccaagcatttaggtgacactatagggatagccaattgcagtttggtttcagagctatgctggaaacagc

SEQ ID NO: 61651 - DNA, 70 bp, Artificial Sequence
  Synthetic
gccaagcatttaggtgacactatagtctctggaaatggatatggagtttcagagctatgctggaaacagc

SEQ ID NO: 61652 - DNA, 70 bp, Artificial Sequence
  Synthetic
gccaagcatttaggtgacactatagagtagacgtgaacaacgcaggtttcagagctatgctggaaacagc

SEQ ID NO: 61653 - DNA, 70 bp, Artificial Sequence
  Synthetic
gccaagcatttaggtgacactatagtctcagttataacagtgaaggtttcagagctatgctggaaacagc

SEQ ID NO: 61654 - DNA, 70 bp, Artificial Sequence
  Synthetic
gccaagcatttaggtgacactatagaattctattgtgtgacttccgtttcagagctatgctggaaacagc

SEQ ID NO: 61655 - DNA, 70 bp, Artificial Sequence
  Synthetic
gccaagcatttaggtgacactatagagaaactagagacagatcaagtttcagagctatgctggaaacagc

SEQ ID NO: 61656 - DNA, 70 bp, Artificial Sequence
  Synthetic
gccaagcatttaggtgacactatagtccgcccccagctcttcatagtttcagagctatgctggaaacagc

SEQ ID NO: 61657 - DNA, 70 bp, Artificial Sequence
  Synthetic
gccaagcatttaggtgacactataggctatacaagcccatttgaagtttcagagctatgctggaaacagc

SEQ ID NO: 61658 - DNA, 70 bp, Artificial Sequence
  Synthetic
gccaagcatttaggtgacactatagaggagttttctgagttttaggtttcagagctatgctggaaacagc

SEQ ID NO: 61659 - DNA, 70 bp, Artificial Sequence
  Synthetic
gccaagcatttaggtgacactatagattggttggtctgcaaagaagtttcagagctatgctggaaacagc

SEQ ID NO: 61660 - DNA, 70 bp, Artificial Sequence
  Synthetic
gccaagcatttaggtgacactatagttcatagtcatcaaagttgcgtttcagagctatgctggaaacagc

SEQ ID NO: 61661 - DNA, 70 bp, Artificial Sequence
  Synthetic
gccaagcatttaggtgacactatagggagagaagaagccctgagcgtttcagagctatgctggaaacagc

SEQ ID NO: 61662 - DNA, 70 bp, Artificial Sequence
  Synthetic
gccaagcatttaggtgacactatagcgtttctgtctccttttgttgtttcagagctatgctggaaacagc

SEQ ID NO: 61663 - DNA, 70 bp, Artificial Sequence
  Synthetic
gccaagcatttaggtgacactatagtcagatcttctcaggccccggtttcagagctatgctggaaacagc

SEQ ID NO: 61664 - DNA, 70 bp, Artificial Sequence
  Synthetic
gccaagcatttaggtgacactatagacacaaaactgttgtactgcgtttcagagctatgctggaaacagc

SEQ ID NO: 61665 - DNA, 70 bp, Artificial Sequence
  Synthetic
gccaagcatttaggtgacactatagaggagcattcccctgggctagtttcagagctatgctggaaacagc

SEQ ID NO: 61666 - DNA, 70 bp, Artificial Sequence
  Synthetic
gccaagcatttaggtgacactataggggcgggagctgtgctcagagtttcagagctatgctggaaacagc

SEQ ID NO: 61667 - DNA, 70 bp, Artificial Sequence
  Synthetic
gccaagcatttaggtgacactataggcgtggatctgggcaacctcgtttcagagctatgctggaaacagc

SEQ ID NO: 61668 - DNA, 70 bp, Artificial Sequence
  Synthetic
gccaagcatttaggtgacactatagtctgggcaacctcgggcagtgtttcagagctatgctggaaacagc

SEQ ID NO: 61669 - DNA, 70 bp, Artificial Sequence
  Synthetic
gccaagcatttaggtgacactatagcatacttttgcttcatgcaggtttcagagctatgctggaaacagc

SEQ ID NO: 61670 - DNA, 70 bp, Artificial Sequence
  Synthetic
gccaagcatttaggtgacactatagtcatactgcactctgtaagagtttcagagctatgctggaaacagc

SEQ ID NO: 61671 - DNA, 70 bp, Artificial Sequence
  Synthetic
gccaagcatttaggtgacactatagatctacttagctcttgacttgtttcagagctatgctggaaacagc

SEQ ID NO: 61672 - DNA, 70 bp, Artificial Sequence
  Synthetic
gccaagcatttaggtgacactatagttggaccaaaatgaatttgcgtttcagagctatgctggaaacagc

SEQ ID NO: 61673 - DNA, 70 bp, Artificial Sequence
  Synthetic
gccaagcatttaggtgacactataggagcacctcctggaagattggtttcagagctatgctggaaacagc

SEQ ID NO: 61674 - DNA, 70 bp, Artificial Sequence
  Synthetic
gccaagcatttaggtgacactatagcagtgggctctcagggcatcgtttcagagctatgctggaaacagc

SEQ ID NO: 61675 - DNA, 70 bp, Artificial Sequence
  Synthetic
gccaagcatttaggtgacactatagggaggggcgtctagaacccggtttcagagctatgctggaaacagc

SEQ ID NO: 61676 - DNA, 70 bp, Artificial Sequence
  Synthetic
gccaagcatttaggtgacactatagcggcgggtgagattacatgagtttcagagctatgctggaaacagc

SEQ ID NO: 61677 - DNA, 70 bp, Artificial Sequence
  Synthetic
gccaagcatttaggtgacactatagtaaggctatggttgcaattcgtttcagagctatgctggaaacagc

SEQ ID NO: 61678 - DNA, 70 bp, Artificial Sequence
  Synthetic
gccaagcatttaggtgacactatagtcttctgcagacatcaaaaggtttcagagctatgctggaaacagc

SEQ ID NO: 61679 - DNA, 70 bp, Artificial Sequence
  Synthetic
gccaagcatttaggtgacactatagcccaccgttccggccgaaaggtttcagagctatgctggaaacagc

SEQ ID NO: 61680 - DNA, 70 bp, Artificial Sequence
  Synthetic
gccaagcatttaggtgacactatagtcatgaaccccgggatggaggtttcagagctatgctggaaacagc

SEQ ID NO: 61681 - DNA, 70 bp, Artificial Sequence
  Synthetic
gccaagcatttaggtgacactatagcgaccatgacgagctctagcgtttcagagctatgctggaaacagc

SEQ ID NO: 61682 - DNA, 70 bp, Artificial Sequence
  Synthetic
gccaagcatttaggtgacactatagtccaccgaggagtcggtgtggtttcagagctatgctggaaacagc

SEQ ID NO: 61683 - DNA, 70 bp, Artificial Sequence
  Synthetic
gccaagcatttaggtgacactatagttataggagatggaactcaggtttcagagctatgctggaaacagc

SEQ ID NO: 61684 - DNA, 70 bp, Artificial Sequence
  Synthetic
gccaagcatttaggtgacactataggagcgcatcagtgttctctggtttcagagctatgctggaaacagc

SEQ ID NO: 61685 - DNA, 70 bp, Artificial Sequence
  Synthetic
gccaagcatttaggtgacactatagggctcctaatccagatgatagtttcagagctatgctggaaacagc

SEQ ID NO: 61686 - DNA, 70 bp, Artificial Sequence
  Synthetic
gccaagcatttaggtgacactatagggatgggagccctggatgtggtttcagagctatgctggaaacagc

SEQ ID NO: 61687 - DNA, 70 bp, Artificial Sequence
  Synthetic
gccaagcatttaggtgacactatagacctgatgacaactcaggatgtttcagagctatgctggaaacagc

SEQ ID NO: 61688 - DNA, 70 bp, Artificial Sequence
  Synthetic
gccaagcatttaggtgacactatagtccagatgagctatcaggctgtttcagagctatgctggaaacagc

SEQ ID NO: 61689 - DNA, 70 bp, Artificial Sequence
  Synthetic
gccaagcatttaggtgacactatagcactggttcgacgtgtagccgtttcagagctatgctggaaacagc

SEQ ID NO: 61690 - DNA, 70 bp, Artificial Sequence
  Synthetic
gccaagcatttaggtgacactatagatcactttgtgcattgccacgtttcagagctatgctggaaacagc

SEQ ID NO: 61691 - DNA, 70 bp, Artificial Sequence
  Synthetic
gccaagcatttaggtgacactatagagcagggcagcccggcgcaggtttcagagctatgctggaaacagc

SEQ ID NO: 61692 - DNA, 70 bp, Artificial Sequence
  Synthetic
gccaagcatttaggtgacactatagagccgcgcccgtgccgcagagtttcagagctatgctggaaacagc

SEQ ID NO: 61693 - DNA, 70 bp, Artificial Sequence
  Synthetic
gccaagcatttaggtgacactataggggcttagcagttgttgttggtttcagagctatgctggaaacagc

SEQ ID NO: 61694 - DNA, 70 bp, Artificial Sequence
  Synthetic
gccaagcatttaggtgacactatagggtgctatgtcgtcccaggagtttcagagctatgctggaaacagc

SEQ ID NO: 61695 - DNA, 70 bp, Artificial Sequence
  Synthetic
gccaagcatttaggtgacactatagccagaatatgaccgtcagcggtttcagagctatgctggaaacagc

SEQ ID NO: 61696 - DNA, 70 bp, Artificial Sequence
  Synthetic
gccaagcatttaggtgacactatagcttattgttctcaggagtccgtttcagagctatgctggaaacagc

SEQ ID NO: 61697 - DNA, 70 bp, Artificial Sequence
  Synthetic
gccaagcatttaggtgacactatagtatatgctcttcagctctacgtttcagagctatgctggaaacagc

SEQ ID NO: 61698 - DNA, 70 bp, Artificial Sequence
  Synthetic
gccaagcatttaggtgacactatagtgagaggcacccaacatcaagtttcagagctatgctggaaacagc

SEQ ID NO: 61699 - DNA, 70 bp, Artificial Sequence
  Synthetic
gccaagcatttaggtgacactatagttagtcaagctatcagtgaagtttcagagctatgctggaaacagc

SEQ ID NO: 61700 - DNA, 70 bp, Artificial Sequence
  Synthetic
gccaagcatttaggtgacactatagaattagtgtcttctacatcggtttcagagctatgctggaaacagc

SEQ ID NO: 61701 - DNA, 70 bp, Artificial Sequence
  Synthetic
gccaagcatttaggtgacactatagccaggaagagaacatgcagagtttcagagctatgctggaaacagc

SEQ ID NO: 61702 - DNA, 70 bp, Artificial Sequence
  Synthetic
gccaagcatttaggtgacactatagggaattgctatggcctcactgtttcagagctatgctggaaacagc

SEQ ID NO: 61703 - DNA, 70 bp, Artificial Sequence
  Synthetic
gccaagcatttaggtgacactatagggcagcatcgctcctgcagagtttcagagctatgctggaaacagc

SEQ ID NO: 61704 - DNA, 70 bp, Artificial Sequence
  Synthetic
gccaagcatttaggtgacactatagtggggtggtcagggacatgcgtttcagagctatgctggaaacagc

SEQ ID NO: 61705 - DNA, 70 bp, Artificial Sequence
  Synthetic
gccaagcatttaggtgacactatagggccttcgttgcgggtcagggtttcagagctatgctggaaacagc

SEQ ID NO: 61706 - DNA, 70 bp, Artificial Sequence
  Synthetic
gccaagcatttaggtgacactatagaccgactaccggatgcgctggtttcagagctatgctggaaacagc

SEQ ID NO: 61707 - DNA, 70 bp, Artificial Sequence
  Synthetic
gccaagcatttaggtgacactatagacacttacttcagagcgctggtttcagagctatgctggaaacagc

SEQ ID NO: 61708 - DNA, 70 bp, Artificial Sequence
  Synthetic
gccaagcatttaggtgacactatagagcagtgtgcatatcttgaggtttcagagctatgctggaaacagc

SEQ ID NO: 61709 - DNA, 70 bp, Artificial Sequence
  Synthetic
gccaagcatttaggtgacactatagcatcaactgtcatctccagagtttcagagctatgctggaaacagc

SEQ ID NO: 61710 - DNA, 70 bp, Artificial Sequence
  Synthetic
gccaagcatttaggtgacactatagctacatgtcagcgtcagagtgtttcagagctatgctggaaacagc

SEQ ID NO: 61711 - DNA, 70 bp, Artificial Sequence
  Synthetic
gccaagcatttaggtgacactatagtgcttttatggctgtttcacgtttcagagctatgctggaaacagc

SEQ ID NO: 61712 - DNA, 70 bp, Artificial Sequence
  Synthetic
gccaagcatttaggtgacactatagcacttggcacgcagggctaggtttcagagctatgctggaaacagc

SEQ ID NO: 61713 - DNA, 70 bp, Artificial Sequence
  Synthetic
gccaagcatttaggtgacactatagaggcaacgctcagtcctccagtttcagagctatgctggaaacagc

SEQ ID NO: 61714 - DNA, 70 bp, Artificial Sequence
  Synthetic
gccaagcatttaggtgacactatagctgcatctcaggaactgctcgtttcagagctatgctggaaacagc

SEQ ID NO: 61715 - DNA, 70 bp, Artificial Sequence
  Synthetic
gccaagcatttaggtgacactatagttgctcaagagtggtcagtcgtttcagagctatgctggaaacagc

SEQ ID NO: 61716 - DNA, 70 bp, Artificial Sequence
  Synthetic
gccaagcatttaggtgacactatagcctcgatttcacagtagactgtttcagagctatgctggaaacagc

SEQ ID NO: 61717 - DNA, 70 bp, Artificial Sequence
  Synthetic
gccaagcatttaggtgacactatagcatccaggttgaaatgggaggtttcagagctatgctggaaacagc

SEQ ID NO: 61718 - DNA, 70 bp, Artificial Sequence
  Synthetic
gccaagcatttaggtgacactatagtctggctttgatctggctcagtttcagagctatgctggaaacagc

SEQ ID NO: 61719 - DNA, 70 bp, Artificial Sequence
  Synthetic
gccaagcatttaggtgacactatagatcttcctgatagtgggatggtttcagagctatgctggaaacagc

SEQ ID NO: 61720 - DNA, 70 bp, Artificial Sequence
  Synthetic
gccaagcatttaggtgacactatagatcggcccggggcctcacaggtttcagagctatgctggaaacagc

SEQ ID NO: 61721 - DNA, 70 bp, Artificial Sequence
  Synthetic
gccaagcatttaggtgacactatagggaagccccccagaagagctgtttcagagctatgctggaaacagc

SEQ ID NO: 61722 - DNA, 70 bp, Artificial Sequence
  Synthetic
gccaagcatttaggtgacactatagtcaaaccccaacctcagttggtttcagagctatgctggaaacagc

SEQ ID NO: 61723 - DNA, 70 bp, Artificial Sequence
  Synthetic
gccaagcatttaggtgacactatagtcttcctgtgcacaggtggagtttcagagctatgctggaaacagc

SEQ ID NO: 61724 - DNA, 70 bp, Artificial Sequence
  Synthetic
gccaagcatttaggtgacactatagtgtgctggcgggtgctaggcgtttcagagctatgctggaaacagc

SEQ ID NO: 61725 - DNA, 70 bp, Artificial Sequence
  Synthetic
gccaagcatttaggtgacactataggaccccctcaggggtgctaggtttcagagctatgctggaaacagc

SEQ ID NO: 61726 - DNA, 70 bp, Artificial Sequence
  Synthetic
gccaagcatttaggtgacactatagattgatgttcttcaagtccagtttcagagctatgctggaaacagc

SEQ ID NO: 61727 - DNA, 70 bp, Artificial Sequence
  Synthetic
gccaagcatttaggtgacactatagtactccagagcgattactttgtttcagagctatgctggaaacagc

SEQ ID NO: 61728 - DNA, 70 bp, Artificial Sequence
  Synthetic
gccaagcatttaggtgacactataggatgcctgccaccgaagagggtttcagagctatgctggaaacagc

SEQ ID NO: 61729 - DNA, 70 bp, Artificial Sequence
  Synthetic
gccaagcatttaggtgacactatagcagaagaggtggactgtatcgtttcagagctatgctggaaacagc

SEQ ID NO: 61730 - DNA, 70 bp, Artificial Sequence
  Synthetic
gccaagcatttaggtgacactatagatcagctatcaatgttgtgagtttcagagctatgctggaaacagc

SEQ ID NO: 61731 - DNA, 70 bp, Artificial Sequence
  Synthetic
gccaagcatttaggtgacactataggttacctccctgaagctgtagtttcagagctatgctggaaacagc

SEQ ID NO: 61732 - DNA, 70 bp, Artificial Sequence
  Synthetic
gccaagcatttaggtgacactatagccatccaagtcctggaactggtttcagagctatgctggaaacagc

SEQ ID NO: 61733 - DNA, 70 bp, Artificial Sequence
  Synthetic
gccaagcatttaggtgacactatagcagagcctccaatttgaacggtttcagagctatgctggaaacagc

SEQ ID NO: 61734 - DNA, 70 bp, Artificial Sequence
  Synthetic
gccaagcatttaggtgacactatagctcactcatgtccatcagttgtttcagagctatgctggaaacagc

SEQ ID NO: 61735 - DNA, 70 bp, Artificial Sequence
  Synthetic
gccaagcatttaggtgacactatagcaagcctgtcccagagtggggtttcagagctatgctggaaacagc

SEQ ID NO: 61736 - DNA, 70 bp, Artificial Sequence
  Synthetic
gccaagcatttaggtgacactatagtgctcagggagagttcgtgagtttcagagctatgctggaaacagc

SEQ ID NO: 61737 - DNA, 70 bp, Artificial Sequence
  Synthetic
gccaagcatttaggtgacactatagttcaaagtcttctggcctccgtttcagagctatgctggaaacagc

SEQ ID NO: 61738 - DNA, 70 bp, Artificial Sequence
  Synthetic
gccaagcatttaggtgacactatagactcatgaagcagctcttgtgtttcagagctatgctggaaacagc

SEQ ID NO: 61739 - DNA, 70 bp, Artificial Sequence
  Synthetic
gccaagcatttaggtgacactatagcttaaccccgaaacagctacgtttcagagctatgctggaaacagc

SEQ ID NO: 61740 - DNA, 70 bp, Artificial Sequence
  Synthetic
gccaagcatttaggtgacactatagaggtctccaggtactcactcgtttcagagctatgctggaaacagc

SEQ ID NO: 61741 - DNA, 70 bp, Artificial Sequence
  Synthetic
gccaagcatttaggtgacactatagtacagacccatccaaatgtggtttcagagctatgctggaaacagc

SEQ ID NO: 61742 - DNA, 70 bp, Artificial Sequence
  Synthetic
gccaagcatttaggtgacactatagtcagaagggccagggcctacgtttcagagctatgctggaaacagc

SEQ ID NO: 61743 - DNA, 70 bp, Artificial Sequence
  Synthetic
gccaagcatttaggtgacactatagacaaagggagatggtgaatggtttcagagctatgctggaaacagc

SEQ ID NO: 61744 - DNA, 70 bp, Artificial Sequence
  Synthetic
gccaagcatttaggtgacactatagcttgcagtagtctcaatcaggtttcagagctatgctggaaacagc

SEQ ID NO: 61745 - DNA, 70 bp, Artificial Sequence
  Synthetic
gccaagcatttaggtgacactataggactcttacataatccccaagtttcagagctatgctggaaacagc

SEQ ID NO: 61746 - DNA, 70 bp, Artificial Sequence
  Synthetic
gccaagcatttaggtgacactatagtcacgacagagcgcatgaaggtttcagagctatgctggaaacagc

SEQ ID NO: 61747 - DNA, 70 bp, Artificial Sequence
  Synthetic
gccaagcatttaggtgacactataggacacacgcagtcattcagggtttcagagctatgctggaaacagc

SEQ ID NO: 61748 - DNA, 70 bp, Artificial Sequence
  Synthetic
gccaagcatttaggtgacactataggccggagagggaatgagtaagtttcagagctatgctggaaacagc

SEQ ID NO: 61749 - DNA, 70 bp, Artificial Sequence
  Synthetic
gccaagcatttaggtgacactatagggctctcttgttctatacttgtttcagagctatgctggaaacagc

SEQ ID NO: 61750 - DNA, 70 bp, Artificial Sequence
  Synthetic
gccaagcatttaggtgacactatagtcctccccctccaacctgatgtttcagagctatgctggaaacagc

SEQ ID NO: 61751 - DNA, 70 bp, Artificial Sequence
  Synthetic
gccaagcatttaggtgacactatagcgagtttgggacctacgcacgtttcagagctatgctggaaacagc

SEQ ID NO: 61752 - DNA, 70 bp, Artificial Sequence
  Synthetic
gccaagcatttaggtgacactatagcaggaccttcaagctgtggagtttcagagctatgctggaaacagc

SEQ ID NO: 61753 - DNA, 70 bp, Artificial Sequence
  Synthetic
gccaagcatttaggtgacactatagaagaacccttttggagcaacgtttcagagctatgctggaaacagc

SEQ ID NO: 61754 - DNA, 70 bp, Artificial Sequence
  Synthetic
gccaagcatttaggtgacactatagagaacagctcattgggtcacgtttcagagctatgctggaaacagc

SEQ ID NO: 61755 - DNA, 70 bp, Artificial Sequence
  Synthetic
gccaagcatttaggtgacactatagcctacagcacgccttcatccgtttcagagctatgctggaaacagc

SEQ ID NO: 61756 - DNA, 70 bp, Artificial Sequence
  Synthetic
gccaagcatttaggtgacactatagatggcaaccgctcaatcagagtttcagagctatgctggaaacagc

SEQ ID NO: 61757 - DNA, 70 bp, Artificial Sequence
  Synthetic
gccaagcatttaggtgacactatagagggaaacggtcaggcatacgtttcagagctatgctggaaacagc

SEQ ID NO: 61758 - DNA, 70 bp, Artificial Sequence
  Synthetic
gccaagcatttaggtgacactatagaccaaggggttcagtaactggtttcagagctatgctggaaacagc

SEQ ID NO: 61759 - DNA, 70 bp, Artificial Sequence
  Synthetic
gccaagcatttaggtgacactatagaggccccagaggctggctgagtttcagagctatgctggaaacagc

SEQ ID NO: 61760 - DNA, 70 bp, Artificial Sequence
  Synthetic
gccaagcatttaggtgacactatagataaagggacatggctgaatgtttcagagctatgctggaaacagc

SEQ ID NO: 61761 - DNA, 70 bp, Artificial Sequence
  Synthetic
gccaagcatttaggtgacactatagataaaggaacatggctgaacgtttcagagctatgctggaaacagc

SEQ ID NO: 61762 - DNA, 70 bp, Artificial Sequence
  Synthetic
gccaagcatttaggtgacactatagttcccattctggatttataggtttcagagctatgctggaaacagc

SEQ ID NO: 61763 - DNA, 70 bp, Artificial Sequence
  Synthetic
gccaagcatttaggtgacactatagccttttccgaaacatcactggtttcagagctatgctggaaacagc

SEQ ID NO: 61764 - DNA, 70 bp, Artificial Sequence
  Synthetic
gccaagcatttaggtgacactatagtcctaccttttcagaaacatgtttcagagctatgctggaaacagc

SEQ ID NO: 61765 - DNA, 70 bp, Artificial Sequence
  Synthetic
gccaagcatttaggtgacactatagtcaaagctgcttgtagaaaggtttcagagctatgctggaaacagc

SEQ ID NO: 61766 - DNA, 70 bp, Artificial Sequence
  Synthetic
gccaagcatttaggtgacactatagtggggcggggtcacccgcaggtttcagagctatgctggaaacagc

SEQ ID NO: 61767 - DNA, 70 bp, Artificial Sequence
  Synthetic
gccaagcatttaggtgacactatagtattcagtcagaatcactgcgtttcagagctatgctggaaacagc

SEQ ID NO: 61768 - DNA, 70 bp, Artificial Sequence
  Synthetic
gccaagcatttaggtgacactatagggagcagccccactggacctgtttcagagctatgctggaaacagc

SEQ ID NO: 61769 - DNA, 70 bp, Artificial Sequence
  Synthetic
gccaagcatttaggtgacactataggaggagcaggaacaatcatcgtttcagagctatgctggaaacagc

SEQ ID NO: 61770 - DNA, 70 bp, Artificial Sequence
  Synthetic
gccaagcatttaggtgacactatagggggctactgcttgtcctcggtttcagagctatgctggaaacagc

SEQ ID NO: 61771 - DNA, 70 bp, Artificial Sequence
  Synthetic
gccaagcatttaggtgacactatagaggacggtcatcaaagtgaagtttcagagctatgctggaaacagc

SEQ ID NO: 61772 - DNA, 70 bp, Artificial Sequence
  Synthetic
gccaagcatttaggtgacactatagcatacatcacacggttgtaggtttcagagctatgctggaaacagc

SEQ ID NO: 61773 - DNA, 70 bp, Artificial Sequence
  Synthetic
gccaagcatttaggtgacactataggctgggctcacagcgtgctcgtttcagagctatgctggaaacagc

SEQ ID NO: 61774 - DNA, 70 bp, Artificial Sequence
  Synthetic
gccaagcatttaggtgacactatagccacccatgagactgtactggtttcagagctatgctggaaacagc

SEQ ID NO: 61775 - DNA, 70 bp, Artificial Sequence
  Synthetic
gccaagcatttaggtgacactatagtagtggtcaatacgcaatgtgtttcagagctatgctggaaacagc

SEQ ID NO: 61776 - DNA, 70 bp, Artificial Sequence
  Synthetic
gccaagcatttaggtgacactatagaggtcaaatgtgctttaatggtttcagagctatgctggaaacagc

SEQ ID NO: 61777 - DNA, 70 bp, Artificial Sequence
  Synthetic
gccaagcatttaggtgacactatagtgtgggaagcagttcattccgtttcagagctatgctggaaacagc

SEQ ID NO: 61778 - DNA, 70 bp, Artificial Sequence
  Synthetic
gccaagcatttaggtgacactatagtgggggtgggggtctatgccgtttcagagctatgctggaaacagc

SEQ ID NO: 61779 - DNA, 70 bp, Artificial Sequence
  Synthetic
gccaagcatttaggtgacactatagtgtgggaggcaactcattccgtttcagagctatgctggaaacagc

SEQ ID NO: 61780 - DNA, 70 bp, Artificial Sequence
  Synthetic
gccaagcatttaggtgacactataggggcacggagatgtctctttgtttcagagctatgctggaaacagc

SEQ ID NO: 61781 - DNA, 70 bp, Artificial Sequence
  Synthetic
gccaagcatttaggtgacactatagtcaccaccgggtggagccacgtttcagagctatgctggaaacagc

SEQ ID NO: 61782 - DNA, 70 bp, Artificial Sequence
  Synthetic
gccaagcatttaggtgacactatagcccttctccctctcttgaacgtttcagagctatgctggaaacagc

SEQ ID NO: 61783 - DNA, 70 bp, Artificial Sequence
  Synthetic
gccaagcatttaggtgacactatagcttacacaacagcacagatcgtttcagagctatgctggaaacagc

SEQ ID NO: 61784 - DNA, 70 bp, Artificial Sequence
  Synthetic
gccaagcatttaggtgacactataggatgttggagatctatggtggtttcagagctatgctggaaacagc

SEQ ID NO: 61785 - DNA, 70 bp, Artificial Sequence
  Synthetic
gccaagcatttaggtgacactataggggccggggtctgtcctcatgtttcagagctatgctggaaacagc

SEQ ID NO: 61786 - DNA, 70 bp, Artificial Sequence
  Synthetic
gccaagcatttaggtgacactataggggaaggcacagtctcacaggtttcagagctatgctggaaacagc

SEQ ID NO: 61787 - DNA, 70 bp, Artificial Sequence
  Synthetic
gccaagcatttaggtgacactatagggaactagactgatgactttgtttcagagctatgctggaaacagc

SEQ ID NO: 61788 - DNA, 70 bp, Artificial Sequence
  Synthetic
gccaagcatttaggtgacactatagcacggaggggctagagtgaggtttcagagctatgctggaaacagc

SEQ ID NO: 61789 - DNA, 70 bp, Artificial Sequence
  Synthetic
gccaagcatttaggtgacactatagccaacagagagcacagctgagtttcagagctatgctggaaacagc

SEQ ID NO: 61790 - DNA, 70 bp, Artificial Sequence
  Synthetic
gccaagcatttaggtgacactatagtacctgtaattccagcacatgtttcagagctatgctggaaacagc

SEQ ID NO: 61791 - DNA, 70 bp, Artificial Sequence
  Synthetic
gccaagcatttaggtgacactatagaggcgctgcaggtcagacctgtttcagagctatgctggaaacagc

SEQ ID NO: 61792 - DNA, 70 bp, Artificial Sequence
  Synthetic
gccaagcatttaggtgacactatagggggctgtggtctggctcaggtttcagagctatgctggaaacagc

SEQ ID NO: 61793 - DNA, 70 bp, Artificial Sequence
  Synthetic
gccaagcatttaggtgacactatagtctggtaatctagaattcaggtttcagagctatgctggaaacagc

SEQ ID NO: 61794 - DNA, 70 bp, Artificial Sequence
  Synthetic
gccaagcatttaggtgacactatagtgaattctagattaccagaggtttcagagctatgctggaaacagc

SEQ ID NO: 61795 - DNA, 70 bp, Artificial Sequence
  Synthetic
gccaagcatttaggtgacactatagggccggcagagtgtcgtgtggtttcagagctatgctggaaacagc

SEQ ID NO: 61796 - DNA, 70 bp, Artificial Sequence
  Synthetic
gccaagcatttaggtgacactatagatagttcaggacagtcacctgtttcagagctatgctggaaacagc

SEQ ID NO: 61797 - DNA, 70 bp, Artificial Sequence
  Synthetic
gccaagcatttaggtgacactatagcaggggtggcgactcagctggtttcagagctatgctggaaacagc

SEQ ID NO: 61798 - DNA, 70 bp, Artificial Sequence
  Synthetic
gccaagcatttaggtgacactatagaggactacagccgtatagaggtttcagagctatgctggaaacagc

SEQ ID NO: 61799 - DNA, 70 bp, Artificial Sequence
  Synthetic
gccaagcatttaggtgacactatagagcagctactttcccttgccgtttcagagctatgctggaaacagc

SEQ ID NO: 61800 - DNA, 70 bp, Artificial Sequence
  Synthetic
gccaagcatttaggtgacactataggccacccaggacagtgtgaggtttcagagctatgctggaaacagc

SEQ ID NO: 61801 - DNA, 70 bp, Artificial Sequence
  Synthetic
gccaagcatttaggtgacactatagttccgagcaggaggcttaccgtttcagagctatgctggaaacagc

SEQ ID NO: 61802 - DNA, 70 bp, Artificial Sequence
  Synthetic
gccaagcatttaggtgacactatagggcaagaggaactccctcaggtttcagagctatgctggaaacagc

SEQ ID NO: 61803 - DNA, 70 bp, Artificial Sequence
  Synthetic
gccaagcatttaggtgacactatagtgtcaaagtggaggagagtagtttcagagctatgctggaaacagc

SEQ ID NO: 61804 - DNA, 70 bp, Artificial Sequence
  Synthetic
gccaagcatttaggtgacactatagtcttcggttttgatcgcctggtttcagagctatgctggaaacagc

SEQ ID NO: 61805 - DNA, 70 bp, Artificial Sequence
  Synthetic
gccaagcatttaggtgacactatagaagtttgcagcttcatttgagtttcagagctatgctggaaacagc

SEQ ID NO: 61806 - DNA, 70 bp, Artificial Sequence
  Synthetic
gccaagcatttaggtgacactatagctggggctcacgtcttgcacgtttcagagctatgctggaaacagc

SEQ ID NO: 61807 - DNA, 70 bp, Artificial Sequence
  Synthetic
gccaagcatttaggtgacactatagtcgaaagcagctcttcagtggtttcagagctatgctggaaacagc

SEQ ID NO: 61808 - DNA, 70 bp, Artificial Sequence
  Synthetic
gccaagcatttaggtgacactatagccctggcgctgacaagtagtgtttcagagctatgctggaaacagc

SEQ ID NO: 61809 - DNA, 70 bp, Artificial Sequence
  Synthetic
gccaagcatttaggtgacactatagtgacaaggtagtcagtgagagtttcagagctatgctggaaacagc

SEQ ID NO: 61810 - DNA, 70 bp, Artificial Sequence
  Synthetic
gccaagcatttaggtgacactataggcagcaccacgagaactactgtttcagagctatgctggaaacagc

SEQ ID NO: 61811 - DNA, 70 bp, Artificial Sequence
  Synthetic
gccaagcatttaggtgacactatagaggcctgggctagggtcccagtttcagagctatgctggaaacagc

SEQ ID NO: 61812 - DNA, 70 bp, Artificial Sequence
  Synthetic
gccaagcatttaggtgacactataggcctcctgcgtcatcaacttgtttcagagctatgctggaaacagc

SEQ ID NO: 61813 - DNA, 70 bp, Artificial Sequence
  Synthetic
gccaagcatttaggtgacactatagtcccacagtgtataagtgaggtttcagagctatgctggaaacagc

SEQ ID NO: 61814 - DNA, 70 bp, Artificial Sequence
  Synthetic
gccaagcatttaggtgacactataggaccgctcttcaaagctcgagtttcagagctatgctggaaacagc

SEQ ID NO: 61815 - DNA, 70 bp, Artificial Sequence
  Synthetic
gccaagcatttaggtgacactatagggcggagggtggggaatgaagtttcagagctatgctggaaacagc

SEQ ID NO: 61816 - DNA, 70 bp, Artificial Sequence
  Synthetic
gccaagcatttaggtgacactataggacaccatagacctgtgaaggtttcagagctatgctggaaacagc

SEQ ID NO: 61817 - DNA, 70 bp, Artificial Sequence
  Synthetic
gccaagcatttaggtgacactatagggcctcccctgatctctcacgtttcagagctatgctggaaacagc

SEQ ID NO: 61818 - DNA, 70 bp, Artificial Sequence
  Synthetic
gccaagcatttaggtgacactatagcaggtgccaacagtcaactggtttcagagctatgctggaaacagc

SEQ ID NO: 61819 - DNA, 70 bp, Artificial Sequence
  Synthetic
gccaagcatttaggtgacactatagggcttcataacggattctaagtttcagagctatgctggaaacagc

SEQ ID NO: 61820 - DNA, 70 bp, Artificial Sequence
  Synthetic
gccaagcatttaggtgacactatagactggacttcagttcaccgtgtttcagagctatgctggaaacagc

SEQ ID NO: 61821 - DNA, 70 bp, Artificial Sequence
  Synthetic
gccaagcatttaggtgacactatagatactgggggctttagctatgtttcagagctatgctggaaacagc

SEQ ID NO: 61822 - DNA, 70 bp, Artificial Sequence
  Synthetic
gccaagcatttaggtgacactatagttggtgacactttttatccagtttcagagctatgctggaaacagc

SEQ ID NO: 61823 - DNA, 70 bp, Artificial Sequence
  Synthetic
gccaagcatttaggtgacactataggcaaaggagagccagattaagtttcagagctatgctggaaacagc

SEQ ID NO: 61824 - DNA, 70 bp, Artificial Sequence
  Synthetic
gccaagcatttaggtgacactatagggaccaggggctttagctgtgtttcagagctatgctggaaacagc

SEQ ID NO: 61825 - DNA, 70 bp, Artificial Sequence
  Synthetic
gccaagcatttaggtgacactataggggctcaggtaggctcagacgtttcagagctatgctggaaacagc

SEQ ID NO: 61826 - DNA, 70 bp, Artificial Sequence
  Synthetic
gccaagcatttaggtgacactatagtggcaatgcccaaggcgggagtttcagagctatgctggaaacagc

SEQ ID NO: 61827 - DNA, 70 bp, Artificial Sequence
  Synthetic
gccaagcatttaggtgacactatagggggccgccgcgcgctcctagtttcagagctatgctggaaacagc

SEQ ID NO: 61828 - DNA, 70 bp, Artificial Sequence
  Synthetic
gccaagcatttaggtgacactatagactacctggattgtagggaggtttcagagctatgctggaaacagc

SEQ ID NO: 61829 - DNA, 70 bp, Artificial Sequence
  Synthetic
gccaagcatttaggtgacactatagggccccgggggtctcacttcgtttcagagctatgctggaaacagc

SEQ ID NO: 61830 - DNA, 70 bp, Artificial Sequence
  Synthetic
gccaagcatttaggtgacactatagggaccgggggctttagctgtgtttcagagctatgctggaaacagc

SEQ ID NO: 61831 - DNA, 70 bp, Artificial Sequence
  Synthetic
gccaagcatttaggtgacactatagcacatatagcccctggattcgtttcagagctatgctggaaacagc

SEQ ID NO: 61832 - DNA, 70 bp, Artificial Sequence
  Synthetic
gccaagcatttaggtgacactatagaacgatgccaattgtgcttagtttcagagctatgctggaaacagc

SEQ ID NO: 61833 - DNA, 70 bp, Artificial Sequence
  Synthetic
gccaagcatttaggtgacactatagtctcctgatccagagctgaggtttcagagctatgctggaaacagc

SEQ ID NO: 61834 - DNA, 70 bp, Artificial Sequence
  Synthetic
gccaagcatttaggtgacactatagctggattgagaacactgctagtttcagagctatgctggaaacagc

SEQ ID NO: 61835 - DNA, 70 bp, Artificial Sequence
  Synthetic
gccaagcatttaggtgacactataggctggctggtcagtgctgtggtttcagagctatgctggaaacagc

SEQ ID NO: 61836 - DNA, 70 bp, Artificial Sequence
  Synthetic
gccaagcatttaggtgacactataggctgctccttgccctgctgtgtttcagagctatgctggaaacagc

SEQ ID NO: 61837 - DNA, 70 bp, Artificial Sequence
  Synthetic
gccaagcatttaggtgacactataggcatcggctgtggtcgctgagtttcagagctatgctggaaacagc

SEQ ID NO: 61838 - DNA, 70 bp, Artificial Sequence
  Synthetic
gccaagcatttaggtgacactatagagggaggtcaggagcccatcgtttcagagctatgctggaaacagc

SEQ ID NO: 61839 - DNA, 70 bp, Artificial Sequence
  Synthetic
gccaagcatttaggtgacactatagtgggagaggcgggaggatgagtttcagagctatgctggaaacagc

SEQ ID NO: 61840 - DNA, 70 bp, Artificial Sequence
  Synthetic
gccaagcatttaggtgacactatagggagagccactgctaaccctgtttcagagctatgctggaaacagc

SEQ ID NO: 61841 - DNA, 70 bp, Artificial Sequence
  Synthetic
gccaagcatttaggtgacactatagtcctgtgagttatctgccccgtttcagagctatgctggaaacagc

SEQ ID NO: 61842 - DNA, 70 bp, Artificial Sequence
  Synthetic
gccaagcatttaggtgacactataggggagggcacacagagtcaggtttcagagctatgctggaaacagc

SEQ ID NO: 61843 - DNA, 70 bp, Artificial Sequence
  Synthetic
gccaagcatttaggtgacactatagcaaccaaccagctgctgacagtttcagagctatgctggaaacagc

SEQ ID NO: 61844 - DNA, 70 bp, Artificial Sequence
  Synthetic
gccaagcatttaggtgacactataggcaaaagaaaacaagcacgagtttcagagctatgctggaaacagc

SEQ ID NO: 61845 - DNA, 70 bp, Artificial Sequence
  Synthetic
gccaagcatttaggtgacactatagaaatagctctgaacaacacagtttcagagctatgctggaaacagc

SEQ ID NO: 61846 - DNA, 70 bp, Artificial Sequence
  Synthetic
gccaagcatttaggtgacactataggcatcagttttgcagatgaagtttcagagctatgctggaaacagc

SEQ ID NO: 61847 - DNA, 70 bp, Artificial Sequence
  Synthetic
gccaagcatttaggtgacactatagagacatggctcagggttgccgtttcagagctatgctggaaacagc

SEQ ID NO: 61848 - DNA, 70 bp, Artificial Sequence
  Synthetic
gccaagcatttaggtgacactatagccgcaaggttgtggctcagggtttcagagctatgctggaaacagc

SEQ ID NO: 61849 - DNA, 70 bp, Artificial Sequence
  Synthetic
gccaagcatttaggtgacactatagctgccacagctcagttatttgtttcagagctatgctggaaacagc

SEQ ID NO: 61850 - DNA, 70 bp, Artificial Sequence
  Synthetic
gccaagcatttaggtgacactatagtggctcagcgagcactgagcgtttcagagctatgctggaaacagc

SEQ ID NO: 61851 - DNA, 70 bp, Artificial Sequence
  Synthetic
gccaagcatttaggtgacactatagaagagaacatccagaagtgagtttcagagctatgctggaaacagc

SEQ ID NO: 61852 - DNA, 70 bp, Artificial Sequence
  Synthetic
gccaagcatttaggtgacactatagatatgcgtcatcaatgagcagtttcagagctatgctggaaacagc

SEQ ID NO: 61853 - DNA, 70 bp, Artificial Sequence
  Synthetic
gccaagcatttaggtgacactatagactgccagtgaaagaatcaggtttcagagctatgctggaaacagc

SEQ ID NO: 61854 - DNA, 70 bp, Artificial Sequence
  Synthetic
gccaagcatttaggtgacactatagctgtgggaggggcggttcaggtttcagagctatgctggaaacagc

SEQ ID NO: 61855 - DNA, 70 bp, Artificial Sequence
  Synthetic
gccaagcatttaggtgacactataggcctctcaacagtcacttctgtttcagagctatgctggaaacagc

SEQ ID NO: 61856 - DNA, 70 bp, Artificial Sequence
  Synthetic
gccaagcatttaggtgacactataggctgaaagaaaagccttagtgtttcagagctatgctggaaacagc

SEQ ID NO: 61857 - DNA, 70 bp, Artificial Sequence
  Synthetic
gccaagcatttaggtgacactataggatggagggggctcaggctggtttcagagctatgctggaaacagc

SEQ ID NO: 61858 - DNA, 70 bp, Artificial Sequence
  Synthetic
gccaagcatttaggtgacactatagcttagtcttcttcatgaacggtttcagagctatgctggaaacagc

SEQ ID NO: 61859 - DNA, 70 bp, Artificial Sequence
  Synthetic
gccaagcatttaggtgacactatagacgccatgtgtggaactagggtttcagagctatgctggaaacagc

SEQ ID NO: 61860 - DNA, 70 bp, Artificial Sequence
  Synthetic
gccaagcatttaggtgacactataggtcacgcgtgttccccagcggtttcagagctatgctggaaacagc

SEQ ID NO: 61861 - DNA, 70 bp, Artificial Sequence
  Synthetic
gccaagcatttaggtgacactatagaattgaagacgttcagaagcgtttcagagctatgctggaaacagc

SEQ ID NO: 61862 - DNA, 70 bp, Artificial Sequence
  Synthetic
gccaagcatttaggtgacactatagcacttcatctcagcctttacgtttcagagctatgctggaaacagc

SEQ ID NO: 61863 - DNA, 70 bp, Artificial Sequence
  Synthetic
gccaagcatttaggtgacactatagcaggggcaggcagtgggcgggtttcagagctatgctggaaacagc

SEQ ID NO: 61864 - DNA, 70 bp, Artificial Sequence
  Synthetic
gccaagcatttaggtgacactatagatccatgtcagctaagtatcgtttcagagctatgctggaaacagc

SEQ ID NO: 61865 - DNA, 70 bp, Artificial Sequence
  Synthetic
gccaagcatttaggtgacactatagtgcttaatgcttggtgtttcgtttcagagctatgctggaaacagc

SEQ ID NO: 61866 - DNA, 70 bp, Artificial Sequence
  Synthetic
gccaagcatttaggtgacactataggctggcttcacagctgattggtttcagagctatgctggaaacagc

SEQ ID NO: 61867 - DNA, 70 bp, Artificial Sequence
  Synthetic
gccaagcatttaggtgacactatagaggctgtacaagataatctggtttcagagctatgctggaaacagc

SEQ ID NO: 61868 - DNA, 70 bp, Artificial Sequence
  Synthetic
gccaagcatttaggtgacactatagcccatcagctctacatctgagtttcagagctatgctggaaacagc

SEQ ID NO: 61869 - DNA, 70 bp, Artificial Sequence
  Synthetic
gccaagcatttaggtgacactataggtatgtgcagaagttgtcaggtttcagagctatgctggaaacagc

SEQ ID NO: 61870 - DNA, 70 bp, Artificial Sequence
  Synthetic
gccaagcatttaggtgacactataggacttcgactgtcatggattgtttcagagctatgctggaaacagc

SEQ ID NO: 61871 - DNA, 70 bp, Artificial Sequence
  Synthetic
gccaagcatttaggtgacactataggttggcaatagggttttagggtttcagagctatgctggaaacagc

SEQ ID NO: 61872 - DNA, 70 bp, Artificial Sequence
  Synthetic
gccaagcatttaggtgacactataggttgtccacctccagcttatgtttcagagctatgctggaaacagc

SEQ ID NO: 61873 - DNA, 70 bp, Artificial Sequence
  Synthetic
gccaagcatttaggtgacactatagtgacatcacggctgctacgtgtttcagagctatgctggaaacagc

SEQ ID NO: 61874 - DNA, 70 bp, Artificial Sequence
  Synthetic
gccaagcatttaggtgacactatagtgacatcacagctgctatgtgtttcagagctatgctggaaacagc

SEQ ID NO: 61875 - DNA, 70 bp, Artificial Sequence
  Synthetic
gccaagcatttaggtgacactatagtgacatcacggctgctataagtttcagagctatgctggaaacagc

SEQ ID NO: 61876 - DNA, 70 bp, Artificial Sequence
  Synthetic
gccaagcatttaggtgacactataggactttgactgtgatggattgtttcagagctatgctggaaacagc

SEQ ID NO: 61877 - DNA, 70 bp, Artificial Sequence
  Synthetic
gccaagcatttaggtgacactatagtgacttcacggctgctatatgtttcagagctatgctggaaacagc

SEQ ID NO: 61878 - DNA, 70 bp, Artificial Sequence
  Synthetic
gccaagcatttaggtgacactatagctctgtctggtttccatggcgtttcagagctatgctggaaacagc

SEQ ID NO: 61879 - DNA, 70 bp, Artificial Sequence
  Synthetic
gccaagcatttaggtgacactatagctttgggaggtcacagcagagtttcagagctatgctggaaacagc

SEQ ID NO: 61880 - DNA, 70 bp, Artificial Sequence
  Synthetic
gccaagcatttaggtgacactataggactctgactgtcacggattgtttcagagctatgctggaaacagc

SEQ ID NO: 61881 - DNA, 70 bp, Artificial Sequence
  Synthetic
gccaagcatttaggtgacactatagcttggcaatagggatttagggtttcagagctatgctggaaacagc

SEQ ID NO: 61882 - DNA, 70 bp, Artificial Sequence
  Synthetic
gccaagcatttaggtgacactatagtcgtaactcagccactggcagtttcagagctatgctggaaacagc

SEQ ID NO: 61883 - DNA, 70 bp, Artificial Sequence
  Synthetic
gccaagcatttaggtgacactataggtcatgactgagactctgtcgtttcagagctatgctggaaacagc

SEQ ID NO: 61884 - DNA, 70 bp, Artificial Sequence
  Synthetic
gccaagcatttaggtgacactatagacgcaagcaagaggaacaaagtttcagagctatgctggaaacagc

SEQ ID NO: 61885 - DNA, 70 bp, Artificial Sequence
  Synthetic
gccaagcatttaggtgacactatagagagactgaaatatctctgagtttcagagctatgctggaaacagc

SEQ ID NO: 61886 - DNA, 70 bp, Artificial Sequence
  Synthetic
gccaagcatttaggtgacactatagcgctaccagcagcaatacaagtttcagagctatgctggaaacagc

SEQ ID NO: 61887 - DNA, 70 bp, Artificial Sequence
  Synthetic
gccaagcatttaggtgacactataggcttacaaaagcgcagacaggtttcagagctatgctggaaacagc

SEQ ID NO: 61888 - DNA, 70 bp, Artificial Sequence
  Synthetic
gccaagcatttaggtgacactatagagaaaaggctgatgaaccaagtttcagagctatgctggaaacagc

SEQ ID NO: 61889 - DNA, 70 bp, Artificial Sequence
  Synthetic
gccaagcatttaggtgacactatagtctcgtcttgtatctctaatgtttcagagctatgctggaaacagc

SEQ ID NO: 61890 - DNA, 70 bp, Artificial Sequence
  Synthetic
gccaagcatttaggtgacactataggcttactccaactgaagttagtttcagagctatgctggaaacagc

SEQ ID NO: 61891 - DNA, 70 bp, Artificial Sequence
  Synthetic
gccaagcatttaggtgacactatagagaagcagagaaatatgctagtttcagagctatgctggaaacagc

SEQ ID NO: 61892 - DNA, 70 bp, Artificial Sequence
  Synthetic
gccaagcatttaggtgacactatagggatggaaggccacatgcatgtttcagagctatgctggaaacagc

SEQ ID NO: 61893 - DNA, 70 bp, Artificial Sequence
  Synthetic
gccaagcatttaggtgacactatagtttcttctcacgctcagcttgtttcagagctatgctggaaacagc

SEQ ID NO: 61894 - DNA, 70 bp, Artificial Sequence
  Synthetic
gccaagcatttaggtgacactatagagaacttgaagaggttatcagtttcagagctatgctggaaacagc

SEQ ID NO: 61895 - DNA, 70 bp, Artificial Sequence
  Synthetic
gccaagcatttaggtgacactatagctctctctgctagagcaacagtttcagagctatgctggaaacagc

SEQ ID NO: 61896 - DNA, 70 bp, Artificial Sequence
  Synthetic
gccaagcatttaggtgacactatagacattgaacttgctgtcatggtttcagagctatgctggaaacagc

SEQ ID NO: 61897 - DNA, 70 bp, Artificial Sequence
  Synthetic
gccaagcatttaggtgacactatagcaatgttttttccaccagacgtttcagagctatgctggaaacagc

SEQ ID NO: 61898 - DNA, 70 bp, Artificial Sequence
  Synthetic
gccaagcatttaggtgacactatagggaaactgtttccttaaggagtttcagagctatgctggaaacagc

SEQ ID NO: 61899 - DNA, 70 bp, Artificial Sequence
  Synthetic
gccaagcatttaggtgacactatagaactgtgcaggctatggagggtttcagagctatgctggaaacagc

SEQ ID NO: 61900 - DNA, 70 bp, Artificial Sequence
  Synthetic
gccaagcatttaggtgacactataggatgccagcagggactgagagtttcagagctatgctggaaacagc

SEQ ID NO: 61901 - DNA, 70 bp, Artificial Sequence
  Synthetic
gccaagcatttaggtgacactatagatgatgttaggagccctgttgtttcagagctatgctggaaacagc

SEQ ID NO: 61902 - DNA, 70 bp, Artificial Sequence
  Synthetic
gccaagcatttaggtgacactataggggaacagggttagtccattgtttcagagctatgctggaaacagc

SEQ ID NO: 61903 - DNA, 70 bp, Artificial Sequence
  Synthetic
gccaagcatttaggtgacactatagcatgtgggcaatatcccagtgtttcagagctatgctggaaacagc

SEQ ID NO: 61904 - DNA, 70 bp, Artificial Sequence
  Synthetic
gccaagcatttaggtgacactatagctgcatccaccctctttcaggtttcagagctatgctggaaacagc

SEQ ID NO: 61905 - DNA, 70 bp, Artificial Sequence
  Synthetic
gccaagcatttaggtgacactatagtctactacgtggacagtgaagtttcagagctatgctggaaacagc

SEQ ID NO: 61906 - DNA, 70 bp, Artificial Sequence
  Synthetic
gccaagcatttaggtgacactatagcaggcggatcactcctccacgtttcagagctatgctggaaacagc

SEQ ID NO: 61907 - DNA, 70 bp, Artificial Sequence
  Synthetic
gccaagcatttaggtgacactatagctagaatcccaggattcagggtttcagagctatgctggaaacagc

SEQ ID NO: 61908 - DNA, 70 bp, Artificial Sequence
  Synthetic
gccaagcatttaggtgacactatagaacaatggacacttcctgaagtttcagagctatgctggaaacagc

SEQ ID NO: 61909 - DNA, 70 bp, Artificial Sequence
  Synthetic
gccaagcatttaggtgacactatagaccgggaagccaatcaataagtttcagagctatgctggaaacagc

SEQ ID NO: 61910 - DNA, 70 bp, Artificial Sequence
  Synthetic
gccaagcatttaggtgacactataggtggaccatcgagtcatcttgtttcagagctatgctggaaacagc

SEQ ID NO: 61911 - DNA, 70 bp, Artificial Sequence
  Synthetic
gccaagcatttaggtgacactatagcattagagatacagcccctcgtttcagagctatgctggaaacagc

SEQ ID NO: 61912 - DNA, 70 bp, Artificial Sequence
  Synthetic
gccaagcatttaggtgacactatagcagttgtatgtcatgtaacggtttcagagctatgctggaaacagc

SEQ ID NO: 61913 - DNA, 70 bp, Artificial Sequence
  Synthetic
gccaagcatttaggtgacactatagttgaagaagggatgagagtggtttcagagctatgctggaaacagc

SEQ ID NO: 61914 - DNA, 70 bp, Artificial Sequence
  Synthetic
gccaagcatttaggtgacactatagaacctacaatactacgcctagtttcagagctatgctggaaacagc

SEQ ID NO: 61915 - DNA, 70 bp, Artificial Sequence
  Synthetic
gccaagcatttaggtgacactatagcctgaccgtgggcccctcaggtttcagagctatgctggaaacagc

SEQ ID NO: 61916 - DNA, 70 bp, Artificial Sequence
  Synthetic
gccaagcatttaggtgacactatagtgtcatcaagaaggacgagcgtttcagagctatgctggaaacagc

SEQ ID NO: 61917 - DNA, 70 bp, Artificial Sequence
  Synthetic
gccaagcatttaggtgacactatagactgtccttctgcatgacctgtttcagagctatgctggaaacagc

SEQ ID NO: 61918 - DNA, 70 bp, Artificial Sequence
  Synthetic
gccaagcatttaggtgacactatagtaagaagctggagtctaaatgtttcagagctatgctggaaacagc

SEQ ID NO: 61919 - DNA, 70 bp, Artificial Sequence
  Synthetic
gccaagcatttaggtgacactatagatatactcaaatggttctgggtttcagagctatgctggaaacagc

SEQ ID NO: 61920 - DNA, 70 bp, Artificial Sequence
  Synthetic
gccaagcatttaggtgacactatagaatgcaccgggcagcagccagtttcagagctatgctggaaacagc

SEQ ID NO: 61921 - DNA, 70 bp, Artificial Sequence
  Synthetic
gccaagcatttaggtgacactatagatactcaagagaatggtggagtttcagagctatgctggaaacagc

SEQ ID NO: 61922 - DNA, 70 bp, Artificial Sequence
  Synthetic
gccaagcatttaggtgacactatagcaaagccaagaaactgacatgtttcagagctatgctggaaacagc

SEQ ID NO: 61923 - DNA, 70 bp, Artificial Sequence
  Synthetic
gccaagcatttaggtgacactataggtttcttggctttgttgtaggtttcagagctatgctggaaacagc

SEQ ID NO: 61924 - DNA, 70 bp, Artificial Sequence
  Synthetic
gccaagcatttaggtgacactatagtacgcatctcatagccaaaggtttcagagctatgctggaaacagc

SEQ ID NO: 61925 - DNA, 70 bp, Artificial Sequence
  Synthetic
gccaagcatttaggtgacactataggcccatgacatcctcacctagtttcagagctatgctggaaacagc

SEQ ID NO: 61926 - DNA, 70 bp, Artificial Sequence
  Synthetic
gccaagcatttaggtgacactatagccagtgtttagcagctatgtgtttcagagctatgctggaaacagc

SEQ ID NO: 61927 - DNA, 70 bp, Artificial Sequence
  Synthetic
gccaagcatttaggtgacactatagcataattggggttcttccgagtttcagagctatgctggaaacagc

SEQ ID NO: 61928 - DNA, 70 bp, Artificial Sequence
  Synthetic
gccaagcatttaggtgacactataggatgacagcttcccttgagcgtttcagagctatgctggaaacagc

SEQ ID NO: 61929 - DNA, 70 bp, Artificial Sequence
  Synthetic
gccaagcatttaggtgacactatagcggcaagaaggacaagaagggtttcagagctatgctggaaacagc

SEQ ID NO: 61930 - DNA, 70 bp, Artificial Sequence
  Synthetic
gccaagcatttaggtgacactataggtttccacgacagcagtagagtttcagagctatgctggaaacagc

SEQ ID NO: 61931 - DNA, 70 bp, Artificial Sequence
  Synthetic
gccaagcatttaggtgacactatagtactgccagttcttgctatcgtttcagagctatgctggaaacagc

SEQ ID NO: 61932 - DNA, 70 bp, Artificial Sequence
  Synthetic
gccaagcatttaggtgacactatagaaaggataggaaagaggacagtttcagagctatgctggaaacagc

SEQ ID NO: 61933 - DNA, 70 bp, Artificial Sequence
  Synthetic
gccaagcatttaggtgacactatagagacgatcatctccagctgcgtttcagagctatgctggaaacagc

SEQ ID NO: 61934 - DNA, 70 bp, Artificial Sequence
  Synthetic
gccaagcatttaggtgacactatagagggacaatcatctttgcaggtttcagagctatgctggaaacagc

SEQ ID NO: 61935 - DNA, 70 bp, Artificial Sequence
  Synthetic
gccaagcatttaggtgacactatagaagcccaggggagaaacaaagtttcagagctatgctggaaacagc

SEQ ID NO: 61936 - DNA, 70 bp, Artificial Sequence
  Synthetic
gccaagcatttaggtgacactatagccctgcaggctaggggttaagtttcagagctatgctggaaacagc

SEQ ID NO: 61937 - DNA, 70 bp, Artificial Sequence
  Synthetic
gccaagcatttaggtgacactatagtccgcaatgcttatgtgagggtttcagagctatgctggaaacagc

SEQ ID NO: 61938 - DNA, 70 bp, Artificial Sequence
  Synthetic
gccaagcatttaggtgacactatagtcccgggttcagtacatagagtttcagagctatgctggaaacagc

SEQ ID NO: 61939 - DNA, 70 bp, Artificial Sequence
  Synthetic
gccaagcatttaggtgacactatagaatgcagagactctgtactggtttcagagctatgctggaaacagc

SEQ ID NO: 61940 - DNA, 70 bp, Artificial Sequence
  Synthetic
gccaagcatttaggtgacactataggcatggtgacacaagaagatgtttcagagctatgctggaaacagc

SEQ ID NO: 61941 - DNA, 70 bp, Artificial Sequence
  Synthetic
gccaagcatttaggtgacactataggcccgaggcctgacagacgcgtttcagagctatgctggaaacagc

SEQ ID NO: 61942 - DNA, 70 bp, Artificial Sequence
  Synthetic
gccaagcatttaggtgacactatagtacattcttgaggccttcacgtttcagagctatgctggaaacagc

SEQ ID NO: 61943 - DNA, 70 bp, Artificial Sequence
  Synthetic
gccaagcatttaggtgacactatagtgagtgactacgtacccggggtttcagagctatgctggaaacagc

SEQ ID NO: 61944 - DNA, 70 bp, Artificial Sequence
  Synthetic
gccaagcatttaggtgacactatagtgcccgcgtctgtcaggcctgtttcagagctatgctggaaacagc

SEQ ID NO: 61945 - DNA, 70 bp, Artificial Sequence
  Synthetic
gccaagcatttaggtgacactatagtctttagtatctcagtgcttgtttcagagctatgctggaaacagc

SEQ ID NO: 61946 - DNA, 70 bp, Artificial Sequence
  Synthetic
gccaagcatttaggtgacactatagattagatcagaaaagtgcaggtttcagagctatgctggaaacagc

SEQ ID NO: 61947 - DNA, 70 bp, Artificial Sequence
  Synthetic
gccaagcatttaggtgacactataggtgtgccaggtgtggtgaccgtttcagagctatgctggaaacagc

SEQ ID NO: 61948 - DNA, 70 bp, Artificial Sequence
  Synthetic
gccaagcatttaggtgacactatagaggtggggcccactctttaagtttcagagctatgctggaaacagc

SEQ ID NO: 61949 - DNA, 70 bp, Artificial Sequence
  Synthetic
gccaagcatttaggtgacactataggccactcagctagaacttttgtttcagagctatgctggaaacagc

SEQ ID NO: 61950 - DNA, 70 bp, Artificial Sequence
  Synthetic
gccaagcatttaggtgacactatagtctctgggaggcttagatcagtttcagagctatgctggaaacagc

SEQ ID NO: 61951 - DNA, 70 bp, Artificial Sequence
  Synthetic
gccaagcatttaggtgacactatagcccgggaagagtacagataagtttcagagctatgctggaaacagc

SEQ ID NO: 61952 - DNA, 70 bp, Artificial Sequence
  Synthetic
gccaagcatttaggtgacactatagagtcaagggggcaactttgagtttcagagctatgctggaaacagc

SEQ ID NO: 61953 - DNA, 70 bp, Artificial Sequence
  Synthetic
gccaagcatttaggtgacactatagtgtagagctgctgggagaacgtttcagagctatgctggaaacagc

SEQ ID NO: 61954 - DNA, 70 bp, Artificial Sequence
  Synthetic
gccaagcatttaggtgacactatagcctgcggctgtggtggctgagtttcagagctatgctggaaacagc

SEQ ID NO: 61955 - DNA, 70 bp, Artificial Sequence
  Synthetic
gccaagcatttaggtgacactatagtggcagtcccaggacctaccgtttcagagctatgctggaaacagc

SEQ ID NO: 61956 - DNA, 70 bp, Artificial Sequence
  Synthetic
gccaagcatttaggtgacactatagagaagaggccattgagcacggtttcagagctatgctggaaacagc

SEQ ID NO: 61957 - DNA, 70 bp, Artificial Sequence
  Synthetic
gccaagcatttaggtgacactatagtcctacctggagaagctttggtttcagagctatgctggaaacagc

SEQ ID NO: 61958 - DNA, 70 bp, Artificial Sequence
  Synthetic
gccaagcatttaggtgacactatagagatgatcccaattactcttgtttcagagctatgctggaaacagc

SEQ ID NO: 61959 - DNA, 70 bp, Artificial Sequence
  Synthetic
gccaagcatttaggtgacactataggaagcagggactaatttttggtttcagagctatgctggaaacagc

SEQ ID NO: 61960 - DNA, 70 bp, Artificial Sequence
  Synthetic
gccaagcatttaggtgacactatagcagtgcatacaggaaatggcgtttcagagctatgctggaaacagc

SEQ ID NO: 61961 - DNA, 70 bp, Artificial Sequence
  Synthetic
gccaagcatttaggtgacactatagtgggggcctgtgcccctagagtttcagagctatgctggaaacagc

SEQ ID NO: 61962 - DNA, 70 bp, Artificial Sequence
  Synthetic
gccaagcatttaggtgacactatagagaaagacactctcagatgagtttcagagctatgctggaaacagc

SEQ ID NO: 61963 - DNA, 70 bp, Artificial Sequence
  Synthetic
gccaagcatttaggtgacactatagattttgagaaggaaactctggtttcagagctatgctggaaacagc

SEQ ID NO: 61964 - DNA, 70 bp, Artificial Sequence
  Synthetic
gccaagcatttaggtgacactatagctgttcccacgagatattttgtttcagagctatgctggaaacagc

SEQ ID NO: 61965 - DNA, 70 bp, Artificial Sequence
  Synthetic
gccaagcatttaggtgacactatagtgcccttgggggcaggtgatgtttcagagctatgctggaaacagc

SEQ ID NO: 61966 - DNA, 70 bp, Artificial Sequence
  Synthetic
gccaagcatttaggtgacactatagaccagggttactcagccaacgtttcagagctatgctggaaacagc

SEQ ID NO: 61967 - DNA, 70 bp, Artificial Sequence
  Synthetic
gccaagcatttaggtgacactatagccactttcatttgccttcacgtttcagagctatgctggaaacagc

SEQ ID NO: 61968 - DNA, 70 bp, Artificial Sequence
  Synthetic
gccaagcatttaggtgacactatagagattttaatcaccctcagtgtttcagagctatgctggaaacagc

SEQ ID NO: 61969 - DNA, 70 bp, Artificial Sequence
  Synthetic
gccaagcatttaggtgacactatagaggcagaggctagatctcctgtttcagagctatgctggaaacagc

SEQ ID NO: 61970 - DNA, 70 bp, Artificial Sequence
  Synthetic
gccaagcatttaggtgacactatagtcagctgctctttcacccaggtttcagagctatgctggaaacagc

SEQ ID NO: 61971 - DNA, 70 bp, Artificial Sequence
  Synthetic
gccaagcatttaggtgacactatagttgtaatttggtcaaccacagtttcagagctatgctggaaacagc

SEQ ID NO: 61972 - DNA, 70 bp, Artificial Sequence
  Synthetic
gccaagcatttaggtgacactatagctgttgtctgaatgaagcccgtttcagagctatgctggaaacagc

SEQ ID NO: 61973 - DNA, 70 bp, Artificial Sequence
  Synthetic
gccaagcatttaggtgacactatagctagcttgaggtaaattcaggtttcagagctatgctggaaacagc

SEQ ID NO: 61974 - DNA, 70 bp, Artificial Sequence
  Synthetic
gccaagcatttaggtgacactatagtcacgtcaccacagtatgaggtttcagagctatgctggaaacagc

SEQ ID NO: 61975 - DNA, 70 bp, Artificial Sequence
  Synthetic
gccaagcatttaggtgacactatagtgcaggctggagctgcctgagtttcagagctatgctggaaacagc

SEQ ID NO: 61976 - DNA, 70 bp, Artificial Sequence
  Synthetic
gccaagcatttaggtgacactatagtcaaaagtcaccaatggcgtgtttcagagctatgctggaaacagc

SEQ ID NO: 61977 - DNA, 70 bp, Artificial Sequence
  Synthetic
gccaagcatttaggtgacactataggcaccaactccaaactgaccgtttcagagctatgctggaaacagc

SEQ ID NO: 61978 - DNA, 70 bp, Artificial Sequence
  Synthetic
gccaagcatttaggtgacactatagtcatcaaaaggttcattctcgtttcagagctatgctggaaacagc

SEQ ID NO: 61979 - DNA, 70 bp, Artificial Sequence
  Synthetic
gccaagcatttaggtgacactatagtggctaactttcaaataggagtttcagagctatgctggaaacagc

SEQ ID NO: 61980 - DNA, 70 bp, Artificial Sequence
  Synthetic
gccaagcatttaggtgacactatagtctcaggacacaaactcaaagtttcagagctatgctggaaacagc

SEQ ID NO: 61981 - DNA, 70 bp, Artificial Sequence
  Synthetic
gccaagcatttaggtgacactatagaagacacctgggagtaggtggtttcagagctatgctggaaacagc

SEQ ID NO: 61982 - DNA, 70 bp, Artificial Sequence
  Synthetic
gccaagcatttaggtgacactatagtgaaaaacactgtcacagacgtttcagagctatgctggaaacagc

SEQ ID NO: 61983 - DNA, 70 bp, Artificial Sequence
  Synthetic
gccaagcatttaggtgacactataggtgggccgggttctaactcggtttcagagctatgctggaaacagc

SEQ ID NO: 61984 - DNA, 70 bp, Artificial Sequence
  Synthetic
gccaagcatttaggtgacactatagtaagtgcatgacggaacaatgtttcagagctatgctggaaacagc

SEQ ID NO: 61985 - DNA, 70 bp, Artificial Sequence
  Synthetic
gccaagcatttaggtgacactatagcctctggttgtgcttagaaggtttcagagctatgctggaaacagc

SEQ ID NO: 61986 - DNA, 70 bp, Artificial Sequence
  Synthetic
gccaagcatttaggtgacactatagagtaaacaggctgacctttggtttcagagctatgctggaaacagc

SEQ ID NO: 61987 - DNA, 70 bp, Artificial Sequence
  Synthetic
gccaagcatttaggtgacactatagaatttccccaaaattcctccgtttcagagctatgctggaaacagc

SEQ ID NO: 61988 - DNA, 70 bp, Artificial Sequence
  Synthetic
gccaagcatttaggtgacactatagcttgatgtggagcgaccattgtttcagagctatgctggaaacagc

SEQ ID NO: 61989 - DNA, 70 bp, Artificial Sequence
  Synthetic
gccaagcatttaggtgacactataggaaggatctttcttaacagcgtttcagagctatgctggaaacagc

SEQ ID NO: 61990 - DNA, 70 bp, Artificial Sequence
  Synthetic
gccaagcatttaggtgacactataggctctaatgatggacagaaagtttcagagctatgctggaaacagc

SEQ ID NO: 61991 - DNA, 70 bp, Artificial Sequence
  Synthetic
gccaagcatttaggtgacactatagtgtctttactgttgagattcgtttcagagctatgctggaaacagc

SEQ ID NO: 61992 - DNA, 70 bp, Artificial Sequence
  Synthetic
gccaagcatttaggtgacactatagtgataagttcagtgtttcacgtttcagagctatgctggaaacagc

SEQ ID NO: 61993 - DNA, 70 bp, Artificial Sequence
  Synthetic
gccaagcatttaggtgacactatagaggcatcagctgctggtcacgtttcagagctatgctggaaacagc

SEQ ID NO: 61994 - DNA, 70 bp, Artificial Sequence
  Synthetic
gccaagcatttaggtgacactatagcgcggggacattcagtgcgcgtttcagagctatgctggaaacagc

SEQ ID NO: 61995 - DNA, 70 bp, Artificial Sequence
  Synthetic
gccaagcatttaggtgacactatagaaaatgccagatctggagtagtttcagagctatgctggaaacagc

SEQ ID NO: 61996 - DNA, 70 bp, Artificial Sequence
  Synthetic
gccaagcatttaggtgacactatagtccacctgccatggatgattgtttcagagctatgctggaaacagc

SEQ ID NO: 61997 - DNA, 70 bp, Artificial Sequence
  Synthetic
gccaagcatttaggtgacactatagatggccaacattggaataaagtttcagagctatgctggaaacagc

SEQ ID NO: 61998 - DNA, 70 bp, Artificial Sequence
  Synthetic
gccaagcatttaggtgacactatagcttgctgatttctctgcaacgtttcagagctatgctggaaacagc

SEQ ID NO: 61999 - DNA, 70 bp, Artificial Sequence
  Synthetic
gccaagcatttaggtgacactatagtcgatggagatggactaggcgtttcagagctatgctggaaacagc

SEQ ID NO: 62000 - DNA, 70 bp, Artificial Sequence
  Synthetic
gccaagcatttaggtgacactatagtcagcttgaaatgtcagcaggtttcagagctatgctggaaacagc

SEQ ID NO: 62001 - DNA, 70 bp, Artificial Sequence
  Synthetic
gccaagcatttaggtgacactatagccatctgctccctgtgtcatgtttcagagctatgctggaaacagc

SEQ ID NO: 62002 - DNA, 70 bp, Artificial Sequence
  Synthetic
gccaagcatttaggtgacactatagtctgaaggacttgctgaaatgtttcagagctatgctggaaacagc

SEQ ID NO: 62003 - DNA, 70 bp, Artificial Sequence
  Synthetic
gccaagcatttaggtgacactatagtgctgaaaggagataatttggtttcagagctatgctggaaacagc

SEQ ID NO: 62004 - DNA, 70 bp, Artificial Sequence
  Synthetic
gccaagcatttaggtgacactatagatgatgacaggaggtaacatgtttcagagctatgctggaaacagc

SEQ ID NO: 62005 - DNA, 70 bp, Artificial Sequence
  Synthetic
gccaagcatttaggtgacactatagaccatccacagagctctgaggtttcagagctatgctggaaacagc

SEQ ID NO: 62006 - DNA, 70 bp, Artificial Sequence
  Synthetic
gccaagcatttaggtgacactatagacgttcttttagtagtactggtttcagagctatgctggaaacagc

SEQ ID NO: 62007 - DNA, 70 bp, Artificial Sequence
  Synthetic
gccaagcatttaggtgacactatagccatgaaaaaagtcttggaggtttcagagctatgctggaaacagc

SEQ ID NO: 62008 - DNA, 70 bp, Artificial Sequence
  Synthetic
gccaagcatttaggtgacactatagtgggagacagtcatgtgaccgtttcagagctatgctggaaacagc

SEQ ID NO: 62009 - DNA, 70 bp, Artificial Sequence
  Synthetic
gccaagcatttaggtgacactatagcatgcacaagctgctggtgtgtttcagagctatgctggaaacagc

SEQ ID NO: 62010 - DNA, 70 bp, Artificial Sequence
  Synthetic
gccaagcatttaggtgacactatagaactgaggatgttctctgaagtttcagagctatgctggaaacagc

SEQ ID NO: 62011 - DNA, 70 bp, Artificial Sequence
  Synthetic
gccaagcatttaggtgacactatagcgtcgctggagctcgattcagtttcagagctatgctggaaacagc

SEQ ID NO: 62012 - DNA, 70 bp, Artificial Sequence
  Synthetic
gccaagcatttaggtgacactatagggagctcgattcacggtaacgtttcagagctatgctggaaacagc

SEQ ID NO: 62013 - DNA, 70 bp, Artificial Sequence
  Synthetic
gccaagcatttaggtgacactatagctaggtgtcaagtactgtgcgtttcagagctatgctggaaacagc

SEQ ID NO: 62014 - DNA, 70 bp, Artificial Sequence
  Synthetic
gccaagcatttaggtgacactatagctcctaggggaggctcagtggtttcagagctatgctggaaacagc

SEQ ID NO: 62015 - DNA, 70 bp, Artificial Sequence
  Synthetic
gccaagcatttaggtgacactatagcccacccacctgcagagtgagtttcagagctatgctggaaacagc

SEQ ID NO: 62016 - DNA, 70 bp, Artificial Sequence
  Synthetic
gccaagcatttaggtgacactatagcgctccacagcagctcaggtgtttcagagctatgctggaaacagc

SEQ ID NO: 62017 - DNA, 70 bp, Artificial Sequence
  Synthetic
gccaagcatttaggtgacactataggtggacagcaagccgtgagggtttcagagctatgctggaaacagc

SEQ ID NO: 62018 - DNA, 70 bp, Artificial Sequence
  Synthetic
gccaagcatttaggtgacactatagtgctgtctagtcatcctcgtgtttcagagctatgctggaaacagc

SEQ ID NO: 62019 - DNA, 70 bp, Artificial Sequence
  Synthetic
gccaagcatttaggtgacactatagggttaggtgggagaggctacgtttcagagctatgctggaaacagc

SEQ ID NO: 62020 - DNA, 70 bp, Artificial Sequence
  Synthetic
gccaagcatttaggtgacactatagcaagaaacaggagaagatgcgtttcagagctatgctggaaacagc

SEQ ID NO: 62021 - DNA, 70 bp, Artificial Sequence
  Synthetic
gccaagcatttaggtgacactatagagcaggagcaacagcaacgagtttcagagctatgctggaaacagc

SEQ ID NO: 62022 - DNA, 70 bp, Artificial Sequence
  Synthetic
gccaagcatttaggtgacactatagccctccaggagtcacagatggtttcagagctatgctggaaacagc

SEQ ID NO: 62023 - DNA, 70 bp, Artificial Sequence
  Synthetic
gccaagcatttaggtgacactatagacagttgtttctatgaccgtgtttcagagctatgctggaaacagc

SEQ ID NO: 62024 - DNA, 70 bp, Artificial Sequence
  Synthetic
gccaagcatttaggtgacactatagccctaaccaatgaagctaaggtttcagagctatgctggaaacagc

SEQ ID NO: 62025 - DNA, 70 bp, Artificial Sequence
  Synthetic
gccaagcatttaggtgacactataggcattgctgtgttcagtagagtttcagagctatgctggaaacagc

SEQ ID NO: 62026 - DNA, 70 bp, Artificial Sequence
  Synthetic
gccaagcatttaggtgacactatagcggggaggaaggtgggcctagtttcagagctatgctggaaacagc

SEQ ID NO: 62027 - DNA, 70 bp, Artificial Sequence
  Synthetic
gccaagcatttaggtgacactatagcctgtcacgtcgggctaggagtttcagagctatgctggaaacagc

SEQ ID NO: 62028 - DNA, 70 bp, Artificial Sequence
  Synthetic
gccaagcatttaggtgacactatagtcaccacgagtgaaagctaggtttcagagctatgctggaaacagc

SEQ ID NO: 62029 - DNA, 70 bp, Artificial Sequence
  Synthetic
gccaagcatttaggtgacactatagactctttaagaacatccagcgtttcagagctatgctggaaacagc

SEQ ID NO: 62030 - DNA, 70 bp, Artificial Sequence
  Synthetic
gccaagcatttaggtgacactatagctgcacgggcaacaaaggatgtttcagagctatgctggaaacagc

SEQ ID NO: 62031 - DNA, 70 bp, Artificial Sequence
  Synthetic
gccaagcatttaggtgacactataggctatgtgttgctgttgaacgtttcagagctatgctggaaacagc

SEQ ID NO: 62032 - DNA, 70 bp, Artificial Sequence
  Synthetic
gccaagcatttaggtgacactatagaacttttctgctgttgcatcgtttcagagctatgctggaaacagc

SEQ ID NO: 62033 - DNA, 70 bp, Artificial Sequence
  Synthetic
gccaagcatttaggtgacactatagggccggtcgtggtgcactgcgtttcagagctatgctggaaacagc

SEQ ID NO: 62034 - DNA, 70 bp, Artificial Sequence
  Synthetic
gccaagcatttaggtgacactatagcaagagatccaccttcagaagtttcagagctatgctggaaacagc

SEQ ID NO: 62035 - DNA, 70 bp, Artificial Sequence
  Synthetic
gccaagcatttaggtgacactatagtcatgtcacttcagaagctggtttcagagctatgctggaaacagc

SEQ ID NO: 62036 - DNA, 70 bp, Artificial Sequence
  Synthetic
gccaagcatttaggtgacactatagttggggtgattaaatgagtcgtttcagagctatgctggaaacagc

SEQ ID NO: 62037 - DNA, 70 bp, Artificial Sequence
  Synthetic
gccaagcatttaggtgacactatagactggcgttagacttacaccgtttcagagctatgctggaaacagc

SEQ ID NO: 62038 - DNA, 70 bp, Artificial Sequence
  Synthetic
gccaagcatttaggtgacactatagtattaggtgtctgtcaatctgtttcagagctatgctggaaacagc

SEQ ID NO: 62039 - DNA, 70 bp, Artificial Sequence
  Synthetic
gccaagcatttaggtgacactatagtggttggcgcttttgttggcgtttcagagctatgctggaaacagc

SEQ ID NO: 62040 - DNA, 70 bp, Artificial Sequence
  Synthetic
gccaagcatttaggtgacactatagcgttcctcttggaaaaagcagtttcagagctatgctggaaacagc

SEQ ID NO: 62041 - DNA, 70 bp, Artificial Sequence
  Synthetic
gccaagcatttaggtgacactatagtcttcggaaacttctgacttgtttcagagctatgctggaaacagc

SEQ ID NO: 62042 - DNA, 70 bp, Artificial Sequence
  Synthetic
gccaagcatttaggtgacactatagtgcctggtgagttcaactctgtttcagagctatgctggaaacagc

SEQ ID NO: 62043 - DNA, 70 bp, Artificial Sequence
  Synthetic
gccaagcatttaggtgacactatagttctggcatggttcaaacgagtttcagagctatgctggaaacagc

SEQ ID NO: 62044 - DNA, 70 bp, Artificial Sequence
  Synthetic
gccaagcatttaggtgacactatagtttgtaattttcagccacacgtttcagagctatgctggaaacagc

SEQ ID NO: 62045 - DNA, 70 bp, Artificial Sequence
  Synthetic
gccaagcatttaggtgacactatagtgtgggagcttagatgagccgtttcagagctatgctggaaacagc

SEQ ID NO: 62046 - DNA, 70 bp, Artificial Sequence
  Synthetic
gccaagcatttaggtgacactatagcaaggaatccaccaccaactgtttcagagctatgctggaaacagc

SEQ ID NO: 62047 - DNA, 70 bp, Artificial Sequence
  Synthetic
gccaagcatttaggtgacactatagacactcaacaagacctgaacgtttcagagctatgctggaaacagc

SEQ ID NO: 62048 - DNA, 70 bp, Artificial Sequence
  Synthetic
gccaagcatttaggtgacactatagcttaactaggatccagcattgtttcagagctatgctggaaacagc

SEQ ID NO: 62049 - DNA, 70 bp, Artificial Sequence
  Synthetic
gccaagcatttaggtgacactatagattgcattcaatgagacacagtttcagagctatgctggaaacagc

SEQ ID NO: 62050 - DNA, 70 bp, Artificial Sequence
  Synthetic
gccaagcatttaggtgacactatagtaggagaagcgcagtcattcgtttcagagctatgctggaaacagc

SEQ ID NO: 62051 - DNA, 70 bp, Artificial Sequence
  Synthetic
gccaagcatttaggtgacactataggcacactaagaacaagaggggtttcagagctatgctggaaacagc

SEQ ID NO: 62052 - DNA, 70 bp, Artificial Sequence
  Synthetic
gccaagcatttaggtgacactatagttccctcaagaggaagtgaggtttcagagctatgctggaaacagc

SEQ ID NO: 62053 - DNA, 70 bp, Artificial Sequence
  Synthetic
gccaagcatttaggtgacactatagcggagggtggcaggggtcaggtttcagagctatgctggaaacagc

SEQ ID NO: 62054 - DNA, 70 bp, Artificial Sequence
  Synthetic
gccaagcatttaggtgacactatagggagagttactgactctccagtttcagagctatgctggaaacagc

SEQ ID NO: 62055 - DNA, 70 bp, Artificial Sequence
  Synthetic
gccaagcatttaggtgacactatagttatgccaacttcaagtaaggtttcagagctatgctggaaacagc

SEQ ID NO: 62056 - DNA, 70 bp, Artificial Sequence
  Synthetic
gccaagcatttaggtgacactatagtctcaatgccttgaatagacgtttcagagctatgctggaaacagc

SEQ ID NO: 62057 - DNA, 70 bp, Artificial Sequence
  Synthetic
gccaagcatttaggtgacactatagatacgctcacaggcacacccgtttcagagctatgctggaaacagc

SEQ ID NO: 62058 - DNA, 70 bp, Artificial Sequence
  Synthetic
gccaagcatttaggtgacactataggcaagtccagctttaaatcagtttcagagctatgctggaaacagc

SEQ ID NO: 62059 - DNA, 70 bp, Artificial Sequence
  Synthetic
gccaagcatttaggtgacactatagtccatgtcaccgcactgtaggtttcagagctatgctggaaacagc

SEQ ID NO: 62060 - DNA, 70 bp, Artificial Sequence
  Synthetic
gccaagcatttaggtgacactatagggggtttctacgttgcataggtttcagagctatgctggaaacagc

SEQ ID NO: 62061 - DNA, 70 bp, Artificial Sequence
  Synthetic
gccaagcatttaggtgacactatagaccacatatggtgcaaacccgtttcagagctatgctggaaacagc

SEQ ID NO: 62062 - DNA, 70 bp, Artificial Sequence
  Synthetic
gccaagcatttaggtgacactataggcggtagttacgttgcataggtttcagagctatgctggaaacagc

SEQ ID NO: 62063 - DNA, 70 bp, Artificial Sequence
  Synthetic
gccaagcatttaggtgacactatagcatggagtccctagtgtgacgtttcagagctatgctggaaacagc

SEQ ID NO: 62064 - DNA, 70 bp, Artificial Sequence
  Synthetic
gccaagcatttaggtgacactatagcatccaggcccacaagttgggtttcagagctatgctggaaacagc

SEQ ID NO: 62065 - DNA, 70 bp, Artificial Sequence
  Synthetic
gccaagcatttaggtgacactatagcggacagtttgcaatagaacgtttcagagctatgctggaaacagc

SEQ ID NO: 62066 - DNA, 70 bp, Artificial Sequence
  Synthetic
gccaagcatttaggtgacactataggaattaggcgatgtaaccatgtttcagagctatgctggaaacagc

SEQ ID NO: 62067 - DNA, 70 bp, Artificial Sequence
  Synthetic
gccaagcatttaggtgacactatagaacacagcagtcggtacaaggtttcagagctatgctggaaacagc

SEQ ID NO: 62068 - DNA, 70 bp, Artificial Sequence
  Synthetic
gccaagcatttaggtgacactatagtacctggaatcatcttagttgtttcagagctatgctggaaacagc

SEQ ID NO: 62069 - DNA, 70 bp, Artificial Sequence
  Synthetic
gccaagcatttaggtgacactatagaatacttgaattctggctgagtttcagagctatgctggaaacagc

SEQ ID NO: 62070 - DNA, 70 bp, Artificial Sequence
  Synthetic
gccaagcatttaggtgacactatagaaggggccccagggtctcacgtttcagagctatgctggaaacagc

SEQ ID NO: 62071 - DNA, 70 bp, Artificial Sequence
  Synthetic
gccaagcatttaggtgacactatagcccctgaggctgccgctcacgtttcagagctatgctggaaacagc

SEQ ID NO: 62072 - DNA, 70 bp, Artificial Sequence
  Synthetic
gccaagcatttaggtgacactatagatcagtgtgtgcaactgatggtttcagagctatgctggaaacagc

SEQ ID NO: 62073 - DNA, 70 bp, Artificial Sequence
  Synthetic
gccaagcatttaggtgacactatagaggtgatgttgagcttgaatgtttcagagctatgctggaaacagc

SEQ ID NO: 62074 - DNA, 70 bp, Artificial Sequence
  Synthetic
gccaagcatttaggtgacactatagacaagtcttcaatgactcacgtttcagagctatgctggaaacagc

SEQ ID NO: 62075 - DNA, 70 bp, Artificial Sequence
  Synthetic
gccaagcatttaggtgacactatagcatggctttaggttgcataggtttcagagctatgctggaaacagc

SEQ ID NO: 62076 - DNA, 70 bp, Artificial Sequence
  Synthetic
gccaagcatttaggtgacactatagccccatcccattgagctaaagtttcagagctatgctggaaacagc

SEQ ID NO: 62077 - DNA, 70 bp, Artificial Sequence
  Synthetic
gccaagcatttaggtgacactataggggctggagtcaagatagcggtttcagagctatgctggaaacagc

SEQ ID NO: 62078 - DNA, 70 bp, Artificial Sequence
  Synthetic
gccaagcatttaggtgacactatagctctcagctatatttccatcgtttcagagctatgctggaaacagc

SEQ ID NO: 62079 - DNA, 70 bp, Artificial Sequence
  Synthetic
gccaagcatttaggtgacactataggatgtggtccaagatcaggtgtttcagagctatgctggaaacagc

SEQ ID NO: 62080 - DNA, 70 bp, Artificial Sequence
  Synthetic
gccaagcatttaggtgacactatagctagtgtcacggccccagtggtttcagagctatgctggaaacagc

SEQ ID NO: 62081 - DNA, 70 bp, Artificial Sequence
  Synthetic
gccaagcatttaggtgacactatagagagattcgccacagttgacgtttcagagctatgctggaaacagc

SEQ ID NO: 62082 - DNA, 70 bp, Artificial Sequence
  Synthetic
gccaagcatttaggtgacactatagtcacctaaaactttactagggtttcagagctatgctggaaacagc

SEQ ID NO: 62083 - DNA, 70 bp, Artificial Sequence
  Synthetic
gccaagcatttaggtgacactataggcagcagttacttgaacaatgtttcagagctatgctggaaacagc

SEQ ID NO: 62084 - DNA, 70 bp, Artificial Sequence
  Synthetic
gccaagcatttaggtgacactatagctccagaaagttcttcctgtgtttcagagctatgctggaaacagc

SEQ ID NO: 62085 - DNA, 70 bp, Artificial Sequence
  Synthetic
gccaagcatttaggtgacactatagatatctatgtcacagcaaacgtttcagagctatgctggaaacagc

SEQ ID NO: 62086 - DNA, 70 bp, Artificial Sequence
  Synthetic
gccaagcatttaggtgacactatagacgggttttcttctttaaacgtttcagagctatgctggaaacagc

SEQ ID NO: 62087 - DNA, 70 bp, Artificial Sequence
  Synthetic
gccaagcatttaggtgacactatagatctagaaacagagatgaacgtttcagagctatgctggaaacagc

SEQ ID NO: 62088 - DNA, 70 bp, Artificial Sequence
  Synthetic
gccaagcatttaggtgacactatagttcaagcattctgtcgacccgtttcagagctatgctggaaacagc

SEQ ID NO: 62089 - DNA, 70 bp, Artificial Sequence
  Synthetic
gccaagcatttaggtgacactatagacatactgagctcctccatggtttcagagctatgctggaaacagc

SEQ ID NO: 62090 - DNA, 70 bp, Artificial Sequence
  Synthetic
gccaagcatttaggtgacactataggggggccaactgcacctgccgtttcagagctatgctggaaacagc

SEQ ID NO: 62091 - DNA, 70 bp, Artificial Sequence
  Synthetic
gccaagcatttaggtgacactataggaagcagttgattacacagagtttcagagctatgctggaaacagc

SEQ ID NO: 62092 - DNA, 70 bp, Artificial Sequence
  Synthetic
gccaagcatttaggtgacactatagttgccctcctatgagtgagagtttcagagctatgctggaaacagc

SEQ ID NO: 62093 - DNA, 70 bp, Artificial Sequence
  Synthetic
gccaagcatttaggtgacactataggggaccactgtcacgcagaggtttcagagctatgctggaaacagc

SEQ ID NO: 62094 - DNA, 70 bp, Artificial Sequence
  Synthetic
gccaagcatttaggtgacactatagccccctaatggtatcatctggtttcagagctatgctggaaacagc

SEQ ID NO: 62095 - DNA, 70 bp, Artificial Sequence
  Synthetic
gccaagcatttaggtgacactatagatttacagcattccatttgggtttcagagctatgctggaaacagc

SEQ ID NO: 62096 - DNA, 70 bp, Artificial Sequence
  Synthetic
gccaagcatttaggtgacactatagtgaaaaactgagcacatagggtttcagagctatgctggaaacagc

SEQ ID NO: 62097 - DNA, 70 bp, Artificial Sequence
  Synthetic
gccaagcatttaggtgacactatagactgcagggtgaggaagaaggtttcagagctatgctggaaacagc

SEQ ID NO: 62098 - DNA, 70 bp, Artificial Sequence
  Synthetic
gccaagcatttaggtgacactataggaggtggatgaggattgaaagtttcagagctatgctggaaacagc

SEQ ID NO: 62099 - DNA, 70 bp, Artificial Sequence
  Synthetic
gccaagcatttaggtgacactataggttcaatttcactctagtcggtttcagagctatgctggaaacagc

SEQ ID NO: 62100 - DNA, 70 bp, Artificial Sequence
  Synthetic
gccaagcatttaggtgacactatagtgatattctctctggatttggtttcagagctatgctggaaacagc

SEQ ID NO: 62101 - DNA, 70 bp, Artificial Sequence
  Synthetic
gccaagcatttaggtgacactatagggggacggagacactgactggtttcagagctatgctggaaacagc

SEQ ID NO: 62102 - DNA, 70 bp, Artificial Sequence
  Synthetic
gccaagcatttaggtgacactataggaaagctagtcatccagagcgtttcagagctatgctggaaacagc

SEQ ID NO: 62103 - DNA, 70 bp, Artificial Sequence
  Synthetic
gccaagcatttaggtgacactatagtttggagacaccaacgaagagtttcagagctatgctggaaacagc

SEQ ID NO: 62104 - DNA, 70 bp, Artificial Sequence
  Synthetic
gccaagcatttaggtgacactatagaggtactgctcagcgaagccgtttcagagctatgctggaaacagc

SEQ ID NO: 62105 - DNA, 70 bp, Artificial Sequence
  Synthetic
gccaagcatttaggtgacactatagctatgctaccgtttgtctgagtttcagagctatgctggaaacagc

SEQ ID NO: 62106 - DNA, 70 bp, Artificial Sequence
  Synthetic
gccaagcatttaggtgacactatagtgagtgtccagggtcatccggtttcagagctatgctggaaacagc

SEQ ID NO: 62107 - DNA, 70 bp, Artificial Sequence
  Synthetic
gccaagcatttaggtgacactatagttagctttcagccaccagaggtttcagagctatgctggaaacagc

SEQ ID NO: 62108 - DNA, 70 bp, Artificial Sequence
  Synthetic
gccaagcatttaggtgacactatagatccacagacagagggcacagtttcagagctatgctggaaacagc

SEQ ID NO: 62109 - DNA, 70 bp, Artificial Sequence
  Synthetic
gccaagcatttaggtgacactatagccgtagtaggtgctcaattagtttcagagctatgctggaaacagc

SEQ ID NO: 62110 - DNA, 70 bp, Artificial Sequence
  Synthetic
gccaagcatttaggtgacactatagtctctctcatcgaactcctagtttcagagctatgctggaaacagc

SEQ ID NO: 62111 - DNA, 70 bp, Artificial Sequence
  Synthetic
gccaagcatttaggtgacactatagtgatcttcattaagactccagtttcagagctatgctggaaacagc

SEQ ID NO: 62112 - DNA, 70 bp, Artificial Sequence
  Synthetic
gccaagcatttaggtgacactatagagactcagaagaagagatgcgtttcagagctatgctggaaacagc

SEQ ID NO: 62113 - DNA, 70 bp, Artificial Sequence
  Synthetic
gccaagcatttaggtgacactataggaccactgtggattcagactgtttcagagctatgctggaaacagc

SEQ ID NO: 62114 - DNA, 70 bp, Artificial Sequence
  Synthetic
gccaagcatttaggtgacactataggcagctgacccccgaagtgcgtttcagagctatgctggaaacagc

SEQ ID NO: 62115 - DNA, 70 bp, Artificial Sequence
  Synthetic
gccaagcatttaggtgacactataggggtagaggtgcagcgagacgtttcagagctatgctggaaacagc

SEQ ID NO: 62116 - DNA, 70 bp, Artificial Sequence
  Synthetic
gccaagcatttaggtgacactatagaacccagtttgaaacgtaacgtttcagagctatgctggaaacagc

SEQ ID NO: 62117 - DNA, 70 bp, Artificial Sequence
  Synthetic
gccaagcatttaggtgacactatagagcaggtgcgccctcatcgtgtttcagagctatgctggaaacagc

SEQ ID NO: 62118 - DNA, 70 bp, Artificial Sequence
  Synthetic
gccaagcatttaggtgacactatagccccttcgagacagacatttgtttcagagctatgctggaaacagc

SEQ ID NO: 62119 - DNA, 70 bp, Artificial Sequence
  Synthetic
gccaagcatttaggtgacactataggagggcggaggaaaagccctgtttcagagctatgctggaaacagc

SEQ ID NO: 62120 - DNA, 70 bp, Artificial Sequence
  Synthetic
gccaagcatttaggtgacactatagaacttttattagcgcttctcgtttcagagctatgctggaaacagc

SEQ ID NO: 62121 - DNA, 70 bp, Artificial Sequence
  Synthetic
gccaagcatttaggtgacactatagaggaagcttcagccgatcttgtttcagagctatgctggaaacagc

SEQ ID NO: 62122 - DNA, 70 bp, Artificial Sequence
  Synthetic
gccaagcatttaggtgacactatagcttcggagcactgtgatcacgtttcagagctatgctggaaacagc

SEQ ID NO: 62123 - DNA, 70 bp, Artificial Sequence
  Synthetic
gccaagcatttaggtgacactataggagggtggagttggcgatgagtttcagagctatgctggaaacagc

SEQ ID NO: 62124 - DNA, 70 bp, Artificial Sequence
  Synthetic
gccaagcatttaggtgacactataggtcccaccatggatctgagggtttcagagctatgctggaaacagc

SEQ ID NO: 62125 - DNA, 70 bp, Artificial Sequence
  Synthetic
gccaagcatttaggtgacactatagcagcggtcgtcacttccccagtttcagagctatgctggaaacagc

SEQ ID NO: 62126 - DNA, 70 bp, Artificial Sequence
  Synthetic
gccaagcatttaggtgacactatagcacctcagggctgcattaatgtttcagagctatgctggaaacagc

SEQ ID NO: 62127 - DNA, 70 bp, Artificial Sequence
  Synthetic
gccaagcatttaggtgacactatagcatctgctataaaacctgccgtttcagagctatgctggaaacagc

SEQ ID NO: 62128 - DNA, 70 bp, Artificial Sequence
  Synthetic
gccaagcatttaggtgacactatagcttcctcaagctcttctgctgtttcagagctatgctggaaacagc

SEQ ID NO: 62129 - DNA, 70 bp, Artificial Sequence
  Synthetic
gccaagcatttaggtgacactatagaggtgttgctgcattttttcgtttcagagctatgctggaaacagc

SEQ ID NO: 62130 - DNA, 70 bp, Artificial Sequence
  Synthetic
gccaagcatttaggtgacactatagtcacagggaaggattctaaagtttcagagctatgctggaaacagc

SEQ ID NO: 62131 - DNA, 70 bp, Artificial Sequence
  Synthetic
gccaagcatttaggtgacactataggaggacctggagcggagctggtttcagagctatgctggaaacagc

SEQ ID NO: 62132 - DNA, 70 bp, Artificial Sequence
  Synthetic
gccaagcatttaggtgacactatagcagcctggccccagcgggcagtttcagagctatgctggaaacagc

SEQ ID NO: 62133 - DNA, 70 bp, Artificial Sequence
  Synthetic
gccaagcatttaggtgacactatagcttgacctttgctctcaggagtttcagagctatgctggaaacagc

SEQ ID NO: 62134 - DNA, 70 bp, Artificial Sequence
  Synthetic
gccaagcatttaggtgacactataggctgcagtccatggctgaccgtttcagagctatgctggaaacagc

SEQ ID NO: 62135 - DNA, 70 bp, Artificial Sequence
  Synthetic
gccaagcatttaggtgacactatagctgggaggcaagaaggactagtttcagagctatgctggaaacagc

SEQ ID NO: 62136 - DNA, 70 bp, Artificial Sequence
  Synthetic
gccaagcatttaggtgacactataggagctcagcagaaagtaggcgtttcagagctatgctggaaacagc

SEQ ID NO: 62137 - DNA, 70 bp, Artificial Sequence
  Synthetic
gccaagcatttaggtgacactatagggctgcagcgggctgcgtgagtttcagagctatgctggaaacagc

SEQ ID NO: 62138 - DNA, 70 bp, Artificial Sequence
  Synthetic
gccaagcatttaggtgacactatagtgaatcaaacgcatctgtctgtttcagagctatgctggaaacagc

SEQ ID NO: 62139 - DNA, 70 bp, Artificial Sequence
  Synthetic
gccaagcatttaggtgacactatagaggcagggtgtgcctagtccgtttcagagctatgctggaaacagc

SEQ ID NO: 62140 - DNA, 70 bp, Artificial Sequence
  Synthetic
gccaagcatttaggtgacactatagtgcccaaaacatctggaacggtttcagagctatgctggaaacagc

SEQ ID NO: 62141 - DNA, 70 bp, Artificial Sequence
  Synthetic
gccaagcatttaggtgacactataggtctggtctggaggctcagagtttcagagctatgctggaaacagc

SEQ ID NO: 62142 - DNA, 70 bp, Artificial Sequence
  Synthetic
gccaagcatttaggtgacactatagacttttggtccatctgcagtgtttcagagctatgctggaaacagc

SEQ ID NO: 62143 - DNA, 70 bp, Artificial Sequence
  Synthetic
gccaagcatttaggtgacactatagagctggtggctgctaacgatgtttcagagctatgctggaaacagc

SEQ ID NO: 62144 - DNA, 70 bp, Artificial Sequence
  Synthetic
gccaagcatttaggtgacactatagatccagcagttccttcaccagtttcagagctatgctggaaacagc

SEQ ID NO: 62145 - DNA, 70 bp, Artificial Sequence
  Synthetic
gccaagcatttaggtgacactatagttatttaaggaactgctggagtttcagagctatgctggaaacagc

SEQ ID NO: 62146 - DNA, 70 bp, Artificial Sequence
  Synthetic
gccaagcatttaggtgacactatagctattccccaaaggcctcaggtttcagagctatgctggaaacagc

SEQ ID NO: 62147 - DNA, 70 bp, Artificial Sequence
  Synthetic
gccaagcatttaggtgacactatagatgatgggagctgtcttaatgtttcagagctatgctggaaacagc

SEQ ID NO: 62148 - DNA, 70 bp, Artificial Sequence
  Synthetic
gccaagcatttaggtgacactatagttcagggtcacatgctcttggtttcagagctatgctggaaacagc

SEQ ID NO: 62149 - DNA, 70 bp, Artificial Sequence
  Synthetic
gccaagcatttaggtgacactataggagggcccagacctgtggtggtttcagagctatgctggaaacagc

SEQ ID NO: 62150 - DNA, 70 bp, Artificial Sequence
  Synthetic
gccaagcatttaggtgacactatagacagagcatggaaatgtttggtttcagagctatgctggaaacagc

SEQ ID NO: 62151 - DNA, 70 bp, Artificial Sequence
  Synthetic
gccaagcatttaggtgacactataggacccaggaaaggtgtgagcgtttcagagctatgctggaaacagc

SEQ ID NO: 62152 - DNA, 70 bp, Artificial Sequence
  Synthetic
gccaagcatttaggtgacactatagactcaccccagcatatttttgtttcagagctatgctggaaacagc

SEQ ID NO: 62153 - DNA, 70 bp, Artificial Sequence
  Synthetic
gccaagcatttaggtgacactatagagagaatgttgttaaccccagtttcagagctatgctggaaacagc

SEQ ID NO: 62154 - DNA, 70 bp, Artificial Sequence
  Synthetic
gccaagcatttaggtgacactataggaaggtcataggttagttgcgtttcagagctatgctggaaacagc

SEQ ID NO: 62155 - DNA, 70 bp, Artificial Sequence
  Synthetic
gccaagcatttaggtgacactatagtccttcatccagcaagtcaagtttcagagctatgctggaaacagc

SEQ ID NO: 62156 - DNA, 70 bp, Artificial Sequence
  Synthetic
gccaagcatttaggtgacactatagttgaattcttagcctttcgtgtttcagagctatgctggaaacagc

SEQ ID NO: 62157 - DNA, 70 bp, Artificial Sequence
  Synthetic
gccaagcatttaggtgacactatagaatcctacaagtctttgtgtgtttcagagctatgctggaaacagc

SEQ ID NO: 62158 - DNA, 70 bp, Artificial Sequence
  Synthetic
gccaagcatttaggtgacactataggccaagcacgctagagccccgtttcagagctatgctggaaacagc

SEQ ID NO: 62159 - DNA, 70 bp, Artificial Sequence
  Synthetic
gccaagcatttaggtgacactatagctcttccggtttaggactaggtttcagagctatgctggaaacagc

SEQ ID NO: 62160 - DNA, 70 bp, Artificial Sequence
  Synthetic
gccaagcatttaggtgacactatagtcagcttccgcttcggtcgggtttcagagctatgctggaaacagc

SEQ ID NO: 62161 - DNA, 70 bp, Artificial Sequence
  Synthetic
gccaagcatttaggtgacactatagagaattctcctttagacagtgtttcagagctatgctggaaacagc

SEQ ID NO: 62162 - DNA, 70 bp, Artificial Sequence
  Synthetic
gccaagcatttaggtgacactatagtcagtgcatagtgcttgcatgtttcagagctatgctggaaacagc

SEQ ID NO: 62163 - DNA, 70 bp, Artificial Sequence
  Synthetic
gccaagcatttaggtgacactatagcagagcgcccagatttcggcgtttcagagctatgctggaaacagc

SEQ ID NO: 62164 - DNA, 70 bp, Artificial Sequence
  Synthetic
gccaagcatttaggtgacactatagagcttcttacagtagccaaagtttcagagctatgctggaaacagc

SEQ ID NO: 62165 - DNA, 70 bp, Artificial Sequence
  Synthetic
gccaagcatttaggtgacactatagaaatgaagatttaggacagggtttcagagctatgctggaaacagc

SEQ ID NO: 62166 - DNA, 70 bp, Artificial Sequence
  Synthetic
gccaagcatttaggtgacactatagaccccacatgtgccggctgagtttcagagctatgctggaaacagc

SEQ ID NO: 62167 - DNA, 70 bp, Artificial Sequence
  Synthetic
gccaagcatttaggtgacactatagccccaggtggttcaggctgcgtttcagagctatgctggaaacagc

SEQ ID NO: 62168 - DNA, 70 bp, Artificial Sequence
  Synthetic
gccaagcatttaggtgacactataggcagcacccgggcactcacagtttcagagctatgctggaaacagc

SEQ ID NO: 62169 - DNA, 70 bp, Artificial Sequence
  Synthetic
gccaagcatttaggtgacactatagggaatcacactgggctgaccgtttcagagctatgctggaaacagc

SEQ ID NO: 62170 - DNA, 70 bp, Artificial Sequence
  Synthetic
gccaagcatttaggtgacactataggatctcaagatgcttgcctggtttcagagctatgctggaaacagc

SEQ ID NO: 62171 - DNA, 70 bp, Artificial Sequence
  Synthetic
gccaagcatttaggtgacactatagtgggtctccaggcctcaggggtttcagagctatgctggaaacagc

SEQ ID NO: 62172 - DNA, 70 bp, Artificial Sequence
  Synthetic
gccaagcatttaggtgacactataggtgatgttcaaactgtagacgtttcagagctatgctggaaacagc

SEQ ID NO: 62173 - DNA, 70 bp, Artificial Sequence
  Synthetic
gccaagcatttaggtgacactatagtgcattctgtgcagctgaaagtttcagagctatgctggaaacagc

SEQ ID NO: 62174 - DNA, 70 bp, Artificial Sequence
  Synthetic
gccaagcatttaggtgacactatagctttcccctcctccatttatgtttcagagctatgctggaaacagc

SEQ ID NO: 62175 - DNA, 70 bp, Artificial Sequence
  Synthetic
gccaagcatttaggtgacactatagacctggagcagcacagctgagtttcagagctatgctggaaacagc

SEQ ID NO: 62176 - DNA, 70 bp, Artificial Sequence
  Synthetic
gccaagcatttaggtgacactatagtgaaatccaacaagttcacggtttcagagctatgctggaaacagc

SEQ ID NO: 62177 - DNA, 70 bp, Artificial Sequence
  Synthetic
gccaagcatttaggtgacactataggtggaggaggcgtgacaggcgtttcagagctatgctggaaacagc

SEQ ID NO: 62178 - DNA, 70 bp, Artificial Sequence
  Synthetic
gccaagcatttaggtgacactatagcagtgctgtcagaacatctagtttcagagctatgctggaaacagc

SEQ ID NO: 62179 - DNA, 70 bp, Artificial Sequence
  Synthetic
gccaagcatttaggtgacactatagaaagctcttgcttcatctgtgtttcagagctatgctggaaacagc

SEQ ID NO: 62180 - DNA, 70 bp, Artificial Sequence
  Synthetic
gccaagcatttaggtgacactatagggtggaggcgcaggggtcacgtttcagagctatgctggaaacagc

SEQ ID NO: 62181 - DNA, 70 bp, Artificial Sequence
  Synthetic
gccaagcatttaggtgacactatagactcaggttggcaaaaaagcgtttcagagctatgctggaaacagc

SEQ ID NO: 62182 - DNA, 70 bp, Artificial Sequence
  Synthetic
gccaagcatttaggtgacactatagtatgaaccatccaggaaagcgtttcagagctatgctggaaacagc

SEQ ID NO: 62183 - DNA, 70 bp, Artificial Sequence
  Synthetic
gccaagcatttaggtgacactatagccatcctggaggtcaagtaggtttcagagctatgctggaaacagc

SEQ ID NO: 62184 - DNA, 70 bp, Artificial Sequence
  Synthetic
gccaagcatttaggtgacactatagatcctcgagatcaaacactagtttcagagctatgctggaaacagc

SEQ ID NO: 62185 - DNA, 70 bp, Artificial Sequence
  Synthetic
gccaagcatttaggtgacactataggtagggtgaggaaggctattgtttcagagctatgctggaaacagc

SEQ ID NO: 62186 - DNA, 70 bp, Artificial Sequence
  Synthetic
gccaagcatttaggtgacactatagaagtaggaaatcaacagcatgtttcagagctatgctggaaacagc

SEQ ID NO: 62187 - DNA, 70 bp, Artificial Sequence
  Synthetic
gccaagcatttaggtgacactatagaacaagtgctccctgggctggtttcagagctatgctggaaacagc

SEQ ID NO: 62188 - DNA, 70 bp, Artificial Sequence
  Synthetic
gccaagcatttaggtgacactatagcaaccccagagagaaggctggtttcagagctatgctggaaacagc

SEQ ID NO: 62189 - DNA, 70 bp, Artificial Sequence
  Synthetic
gccaagcatttaggtgacactatagacacaggactcagcaccagcgtttcagagctatgctggaaacagc

SEQ ID NO: 62190 - DNA, 70 bp, Artificial Sequence
  Synthetic
gccaagcatttaggtgacactatagtttaatgttgaggttggtgcgtttcagagctatgctggaaacagc

SEQ ID NO: 62191 - DNA, 70 bp, Artificial Sequence
  Synthetic
gccaagcatttaggtgacactatagccaggagtggctgcacctaggtttcagagctatgctggaaacagc

SEQ ID NO: 62192 - DNA, 70 bp, Artificial Sequence
  Synthetic
gccaagcatttaggtgacactatagcacagagcaataaccaccacgtttcagagctatgctggaaacagc

SEQ ID NO: 62193 - DNA, 70 bp, Artificial Sequence
  Synthetic
gccaagcatttaggtgacactatagtgctctgtgttataaactctgtttcagagctatgctggaaacagc

SEQ ID NO: 62194 - DNA, 70 bp, Artificial Sequence
  Synthetic
gccaagcatttaggtgacactatagaaacatcttagcaagtgcaggtttcagagctatgctggaaacagc

SEQ ID NO: 62195 - DNA, 70 bp, Artificial Sequence
  Synthetic
gccaagcatttaggtgacactatagccagtcaagcagtcaggtgggtttcagagctatgctggaaacagc

SEQ ID NO: 62196 - DNA, 70 bp, Artificial Sequence
  Synthetic
gccaagcatttaggtgacactatagggcggtggctgttgctaggagtttcagagctatgctggaaacagc

SEQ ID NO: 62197 - DNA, 70 bp, Artificial Sequence
  Synthetic
gccaagcatttaggtgacactatagtcaggcacaacacccagatcgtttcagagctatgctggaaacagc

SEQ ID NO: 62198 - DNA, 70 bp, Artificial Sequence
  Synthetic
gccaagcatttaggtgacactatagggtggagggtgctgttcttcgtttcagagctatgctggaaacagc

SEQ ID NO: 62199 - DNA, 70 bp, Artificial Sequence
  Synthetic
gccaagcatttaggtgacactatagggtcagcagcagctccgcttgtttcagagctatgctggaaacagc

SEQ ID NO: 62200 - DNA, 70 bp, Artificial Sequence
  Synthetic
gccaagcatttaggtgacactatagggtatgctacagctgctaaagtttcagagctatgctggaaacagc

SEQ ID NO: 62201 - DNA, 70 bp, Artificial Sequence
  Synthetic
gccaagcatttaggtgacactatagatgacaacagctgtagaagtgtttcagagctatgctggaaacagc

SEQ ID NO: 62202 - DNA, 70 bp, Artificial Sequence
  Synthetic
gccaagcatttaggtgacactataggtggtgctggccaaggtcaggtttcagagctatgctggaaacagc

SEQ ID NO: 62203 - DNA, 70 bp, Artificial Sequence
  Synthetic
gccaagcatttaggtgacactatagctgagctcagccaggttcaagtttcagagctatgctggaaacagc

SEQ ID NO: 62204 - DNA, 70 bp, Artificial Sequence
  Synthetic
gccaagcatttaggtgacactataggaaaaggagaaaggggcatggtttcagagctatgctggaaacagc

SEQ ID NO: 62205 - DNA, 70 bp, Artificial Sequence
  Synthetic
gccaagcatttaggtgacactatagtagcagatacatttcttctcgtttcagagctatgctggaaacagc

SEQ ID NO: 62206 - DNA, 70 bp, Artificial Sequence
  Synthetic
gccaagcatttaggtgacactatagacagattctactctgagtaggtttcagagctatgctggaaacagc

SEQ ID NO: 62207 - DNA, 70 bp, Artificial Sequence
  Synthetic
gccaagcatttaggtgacactatagactgcacacatagagcttctgtttcagagctatgctggaaacagc

SEQ ID NO: 62208 - DNA, 70 bp, Artificial Sequence
  Synthetic
gccaagcatttaggtgacactatagagcagaaatagaacagtcacgtttcagagctatgctggaaacagc

SEQ ID NO: 62209 - DNA, 70 bp, Artificial Sequence
  Synthetic
gccaagcatttaggtgacactatagagccaaacactactagcagcgtttcagagctatgctggaaacagc

SEQ ID NO: 62210 - DNA, 70 bp, Artificial Sequence
  Synthetic
gccaagcatttaggtgacactatagggaggacagcaggctggggggtttcagagctatgctggaaacagc

SEQ ID NO: 62211 - DNA, 70 bp, Artificial Sequence
  Synthetic
gccaagcatttaggtgacactatagtgttcagcagcagccagagtgtttcagagctatgctggaaacagc

SEQ ID NO: 62212 - DNA, 70 bp, Artificial Sequence
  Synthetic
gccaagcatttaggtgacactatagcctcacccttacctggagaagtttcagagctatgctggaaacagc

SEQ ID NO: 62213 - DNA, 70 bp, Artificial Sequence
  Synthetic
gccaagcatttaggtgacactatagggcccttgggtcaacagcacgtttcagagctatgctggaaacagc

SEQ ID NO: 62214 - DNA, 70 bp, Artificial Sequence
  Synthetic
gccaagcatttaggtgacactatagaagccatatatcagcaacacgtttcagagctatgctggaaacagc

SEQ ID NO: 62215 - DNA, 70 bp, Artificial Sequence
  Synthetic
gccaagcatttaggtgacactatagcgtttggtttcaacaaggacgtttcagagctatgctggaaacagc

SEQ ID NO: 62216 - DNA, 70 bp, Artificial Sequence
  Synthetic
gccaagcatttaggtgacactatagcaaagcctgcaatgacgtgcgtttcagagctatgctggaaacagc

SEQ ID NO: 62217 - DNA, 70 bp, Artificial Sequence
  Synthetic
gccaagcatttaggtgacactatagaatgtccaggggtcaagctcgtttcagagctatgctggaaacagc

SEQ ID NO: 62218 - DNA, 70 bp, Artificial Sequence
  Synthetic
gccaagcatttaggtgacactatagacagtctcctcagccctcatgtttcagagctatgctggaaacagc

SEQ ID NO: 62219 - DNA, 70 bp, Artificial Sequence
  Synthetic
gccaagcatttaggtgacactataggctggcaggggggctatggggtttcagagctatgctggaaacagc

SEQ ID NO: 62220 - DNA, 70 bp, Artificial Sequence
  Synthetic
gccaagcatttaggtgacactatagagcctgggctgctgctaactgtttcagagctatgctggaaacagc

SEQ ID NO: 62221 - DNA, 70 bp, Artificial Sequence
  Synthetic
gccaagcatttaggtgacactatagctccctgcacacacacggacgtttcagagctatgctggaaacagc

SEQ ID NO: 62222 - DNA, 70 bp, Artificial Sequence
  Synthetic
gccaagcatttaggtgacactataggccccctgggattcacatgagtttcagagctatgctggaaacagc

SEQ ID NO: 62223 - DNA, 70 bp, Artificial Sequence
  Synthetic
gccaagcatttaggtgacactatagtggctgtgccaaatcctagtgtttcagagctatgctggaaacagc

SEQ ID NO: 62224 - DNA, 70 bp, Artificial Sequence
  Synthetic
gccaagcatttaggtgacactatagtcagcagaagcattctttccgtttcagagctatgctggaaacagc

SEQ ID NO: 62225 - DNA, 70 bp, Artificial Sequence
  Synthetic
gccaagcatttaggtgacactatagaagaggttgtcaaatcagaggtttcagagctatgctggaaacagc

SEQ ID NO: 62226 - DNA, 70 bp, Artificial Sequence
  Synthetic
gccaagcatttaggtgacactatagggagtgggatggctctcagcgtttcagagctatgctggaaacagc

SEQ ID NO: 62227 - DNA, 70 bp, Artificial Sequence
  Synthetic
gccaagcatttaggtgacactataggcagcagaactgctcatgctgtttcagagctatgctggaaacagc

SEQ ID NO: 62228 - DNA, 70 bp, Artificial Sequence
  Synthetic
gccaagcatttaggtgacactataggtgtgcacggggacactagcgtttcagagctatgctggaaacagc

SEQ ID NO: 62229 - DNA, 70 bp, Artificial Sequence
  Synthetic
gccaagcatttaggtgacactatagtctctagcagctgcagctgcgtttcagagctatgctggaaacagc

SEQ ID NO: 62230 - DNA, 70 bp, Artificial Sequence
  Synthetic
gccaagcatttaggtgacactatagatgctagaagaatcagaagagtttcagagctatgctggaaacagc

SEQ ID NO: 62231 - DNA, 70 bp, Artificial Sequence
  Synthetic
gccaagcatttaggtgacactatagcttacacctcattgaagctggtttcagagctatgctggaaacagc

SEQ ID NO: 62232 - DNA, 70 bp, Artificial Sequence
  Synthetic
gccaagcatttaggtgacactatagttcttcccccaggaggcttagtttcagagctatgctggaaacagc

SEQ ID NO: 62233 - DNA, 70 bp, Artificial Sequence
  Synthetic
gccaagcatttaggtgacactatagaaagctgggttatttcaaaggtttcagagctatgctggaaacagc

SEQ ID NO: 62234 - DNA, 70 bp, Artificial Sequence
  Synthetic
gccaagcatttaggtgacactatagtacattcgatacattcagcagtttcagagctatgctggaaacagc

SEQ ID NO: 62235 - DNA, 70 bp, Artificial Sequence
  Synthetic
gccaagcatttaggtgacactatagagaaattttgcagctgtttcgtttcagagctatgctggaaacagc

SEQ ID NO: 62236 - DNA, 70 bp, Artificial Sequence
  Synthetic
gccaagcatttaggtgacactatagaactgcaagatctcctagcggtttcagagctatgctggaaacagc

SEQ ID NO: 62237 - DNA, 70 bp, Artificial Sequence
  Synthetic
gccaagcatttaggtgacactatagctggaatccttcgaggagtcgtttcagagctatgctggaaacagc

SEQ ID NO: 62238 - DNA, 70 bp, Artificial Sequence
  Synthetic
gccaagcatttaggtgacactatagttctctcctagagtcaacacgtttcagagctatgctggaaacagc

SEQ ID NO: 62239 - DNA, 70 bp, Artificial Sequence
  Synthetic
gccaagcatttaggtgacactataggtcacggcccacagctaggtgtttcagagctatgctggaaacagc

SEQ ID NO: 62240 - DNA, 70 bp, Artificial Sequence
  Synthetic
gccaagcatttaggtgacactatagtggggctgcgggtgctgaccgtttcagagctatgctggaaacagc

SEQ ID NO: 62241 - DNA, 70 bp, Artificial Sequence
  Synthetic
gccaagcatttaggtgacactatagaagaggccgcccaagagattgtttcagagctatgctggaaacagc

SEQ ID NO: 62242 - DNA, 70 bp, Artificial Sequence
  Synthetic
gccaagcatttaggtgacactatagcgctcaggagtgtggttgttgtttcagagctatgctggaaacagc

SEQ ID NO: 62243 - DNA, 70 bp, Artificial Sequence
  Synthetic
gccaagcatttaggtgacactatagcacagagctcagcagccacagtttcagagctatgctggaaacagc

SEQ ID NO: 62244 - DNA, 70 bp, Artificial Sequence
  Synthetic
gccaagcatttaggtgacactataggttactacaacactgattccgtttcagagctatgctggaaacagc

SEQ ID NO: 62245 - DNA, 70 bp, Artificial Sequence
  Synthetic
gccaagcatttaggtgacactatagcagtgttgtagcaactgagggtttcagagctatgctggaaacagc

SEQ ID NO: 62246 - DNA, 70 bp, Artificial Sequence
  Synthetic
gccaagcatttaggtgacactataggggctcagttgctgcagcacgtttcagagctatgctggaaacagc

SEQ ID NO: 62247 - DNA, 70 bp, Artificial Sequence
  Synthetic
gccaagcatttaggtgacactatagagatgacatgggagattagcgtttcagagctatgctggaaacagc

SEQ ID NO: 62248 - DNA, 70 bp, Artificial Sequence
  Synthetic
gccaagcatttaggtgacactatagcaggtcggctctgcattagcgtttcagagctatgctggaaacagc

SEQ ID NO: 62249 - DNA, 70 bp, Artificial Sequence
  Synthetic
gccaagcatttaggtgacactatagcattgctgcctgtctcgtgggtttcagagctatgctggaaacagc

SEQ ID NO: 62250 - DNA, 70 bp, Artificial Sequence
  Synthetic
gccaagcatttaggtgacactatagttctgatatggagttggcatgtttcagagctatgctggaaacagc

SEQ ID NO: 62251 - DNA, 70 bp, Artificial Sequence
  Synthetic
gccaagcatttaggtgacactatagagcagcatctgctccttgacgtttcagagctatgctggaaacagc

SEQ ID NO: 62252 - DNA, 70 bp, Artificial Sequence
  Synthetic
gccaagcatttaggtgacactatagttccgatgtgttcttctgtggtttcagagctatgctggaaacagc

SEQ ID NO: 62253 - DNA, 70 bp, Artificial Sequence
  Synthetic
gccaagcatttaggtgacactatagtagcgagcaacgaaagaaacgtttcagagctatgctggaaacagc

SEQ ID NO: 62254 - DNA, 70 bp, Artificial Sequence
  Synthetic
gccaagcatttaggtgacactatagaatcaacagcaagatgagctgtttcagagctatgctggaaacagc

SEQ ID NO: 62255 - DNA, 70 bp, Artificial Sequence
  Synthetic
gccaagcatttaggtgacactatagacagcacgaagaccctgcttgtttcagagctatgctggaaacagc

SEQ ID NO: 62256 - DNA, 70 bp, Artificial Sequence
  Synthetic
gccaagcatttaggtgacactataggtcccagaagacacctcacagtttcagagctatgctggaaacagc

SEQ ID NO: 62257 - DNA, 70 bp, Artificial Sequence
  Synthetic
gccaagcatttaggtgacactatagatgcaatatggtatcctggagtttcagagctatgctggaaacagc

SEQ ID NO: 62258 - DNA, 70 bp, Artificial Sequence
  Synthetic
gccaagcatttaggtgacactatagccatgagggtgtcatgtctcgtttcagagctatgctggaaacagc

SEQ ID NO: 62259 - DNA, 70 bp, Artificial Sequence
  Synthetic
gccaagcatttaggtgacactatagggacatcaaggacacctgaggtttcagagctatgctggaaacagc

SEQ ID NO: 62260 - DNA, 70 bp, Artificial Sequence
  Synthetic
gccaagcatttaggtgacactatagcgattgtattgtgactgtaggtttcagagctatgctggaaacagc

SEQ ID NO: 62261 - DNA, 70 bp, Artificial Sequence
  Synthetic
gccaagcatttaggtgacactatagagacagcaaccggggttcaagtttcagagctatgctggaaacagc

SEQ ID NO: 62262 - DNA, 70 bp, Artificial Sequence
  Synthetic
gccaagcatttaggtgacactatagctggaactatgtgctctcctgtttcagagctatgctggaaacagc

SEQ ID NO: 62263 - DNA, 70 bp, Artificial Sequence
  Synthetic
gccaagcatttaggtgacactataggctgcaacaggaagacccaagtttcagagctatgctggaaacagc

SEQ ID NO: 62264 - DNA, 70 bp, Artificial Sequence
  Synthetic
gccaagcatttaggtgacactatagctgcaacctcaagtttatgcgtttcagagctatgctggaaacagc

SEQ ID NO: 62265 - DNA, 70 bp, Artificial Sequence
  Synthetic
gccaagcatttaggtgacactatagtagcagcgtcctcacctaaggtttcagagctatgctggaaacagc

SEQ ID NO: 62266 - DNA, 70 bp, Artificial Sequence
  Synthetic
gccaagcatttaggtgacactatagtgaatctagctcactagctcgtttcagagctatgctggaaacagc

SEQ ID NO: 62267 - DNA, 70 bp, Artificial Sequence
  Synthetic
gccaagcatttaggtgacactatagcccctcccctcagttactcagtttcagagctatgctggaaacagc

SEQ ID NO: 62268 - DNA, 70 bp, Artificial Sequence
  Synthetic
gccaagcatttaggtgacactatagggcctctccccacagctgaggtttcagagctatgctggaaacagc

SEQ ID NO: 62269 - DNA, 70 bp, Artificial Sequence
  Synthetic
gccaagcatttaggtgacactatagcatcgagaccccatcagagggtttcagagctatgctggaaacagc

SEQ ID NO: 62270 - DNA, 70 bp, Artificial Sequence
  Synthetic
gccaagcatttaggtgacactataggatcggaaaagatttggggcgtttcagagctatgctggaaacagc

SEQ ID NO: 62271 - DNA, 70 bp, Artificial Sequence
  Synthetic
gccaagcatttaggtgacactataggactacgaggagctctaggcgtttcagagctatgctggaaacagc

SEQ ID NO: 62272 - DNA, 70 bp, Artificial Sequence
  Synthetic
gccaagcatttaggtgacactatagtcagctgctccattccctaagtttcagagctatgctggaaacagc

SEQ ID NO: 62273 - DNA, 70 bp, Artificial Sequence
  Synthetic
gccaagcatttaggtgacactataggctgagacatttacaacagcgtttcagagctatgctggaaacagc

SEQ ID NO: 62274 - DNA, 70 bp, Artificial Sequence
  Synthetic
gccaagcatttaggtgacactataggcgcctgcagcctcctctaggtttcagagctatgctggaaacagc

SEQ ID NO: 62275 - DNA, 70 bp, Artificial Sequence
  Synthetic
gccaagcatttaggtgacactatagtgggccagggctctagaagagtttcagagctatgctggaaacagc

SEQ ID NO: 62276 - DNA, 70 bp, Artificial Sequence
  Synthetic
gccaagcatttaggtgacactatagcctgaagacagtgtttgacggtttcagagctatgctggaaacagc

SEQ ID NO: 62277 - DNA, 70 bp, Artificial Sequence
  Synthetic
gccaagcatttaggtgacactatagatgtgacttcacttgagcatgtttcagagctatgctggaaacagc

SEQ ID NO: 62278 - DNA, 70 bp, Artificial Sequence
  Synthetic
gccaagcatttaggtgacactatagaaacttctagcgtgtgccaagtttcagagctatgctggaaacagc

SEQ ID NO: 62279 - DNA, 70 bp, Artificial Sequence
  Synthetic
gccaagcatttaggtgacactatagcatactcaagactcagattcgtttcagagctatgctggaaacagc

SEQ ID NO: 62280 - DNA, 70 bp, Artificial Sequence
  Synthetic
gccaagcatttaggtgacactatagtagaagactacgagagtgatgtttcagagctatgctggaaacagc

SEQ ID NO: 62281 - DNA, 70 bp, Artificial Sequence
  Synthetic
gccaagcatttaggtgacactatagaaccaagaaacaagcgtaatgtttcagagctatgctggaaacagc

SEQ ID NO: 62282 - DNA, 70 bp, Artificial Sequence
  Synthetic
gccaagcatttaggtgacactatagtcatcgcaacacctggaccagtttcagagctatgctggaaacagc

SEQ ID NO: 62283 - DNA, 70 bp, Artificial Sequence
  Synthetic
gccaagcatttaggtgacactatagtgcagatattatagctacgagtttcagagctatgctggaaacagc

SEQ ID NO: 62284 - DNA, 70 bp, Artificial Sequence
  Synthetic
gccaagcatttaggtgacactatagcgtcatcaaagttctgactcgtttcagagctatgctggaaacagc

SEQ ID NO: 62285 - DNA, 70 bp, Artificial Sequence
  Synthetic
gccaagcatttaggtgacactataggcttgtatcacaagtccttcgtttcagagctatgctggaaacagc

SEQ ID NO: 62286 - DNA, 70 bp, Artificial Sequence
  Synthetic
gccaagcatttaggtgacactatagaaatgcagtgttagctccctgtttcagagctatgctggaaacagc

SEQ ID NO: 62287 - DNA, 70 bp, Artificial Sequence
  Synthetic
gccaagcatttaggtgacactatagaaacccaatgattcagtcttgtttcagagctatgctggaaacagc

SEQ ID NO: 62288 - DNA, 70 bp, Artificial Sequence
  Synthetic
gccaagcatttaggtgacactatagagcttcagcttcaggaagacgtttcagagctatgctggaaacagc

SEQ ID NO: 62289 - DNA, 70 bp, Artificial Sequence
  Synthetic
gccaagcatttaggtgacactataggtaccacactcaggtgctaggtttcagagctatgctggaaacagc

SEQ ID NO: 62290 - DNA, 70 bp, Artificial Sequence
  Synthetic
gccaagcatttaggtgacactatagttggtttgtcaagaaaagcagtttcagagctatgctggaaacagc

SEQ ID NO: 62291 - DNA, 70 bp, Artificial Sequence
  Synthetic
gccaagcatttaggtgacactatagatctgtagtcctagctgctcgtttcagagctatgctggaaacagc

SEQ ID NO: 62292 - DNA, 70 bp, Artificial Sequence
  Synthetic
gccaagcatttaggtgacactatagaaaactaggctgggttacacgtttcagagctatgctggaaacagc

SEQ ID NO: 62293 - DNA, 70 bp, Artificial Sequence
  Synthetic
gccaagcatttaggtgacactatagagtatccctatggcttctctgtttcagagctatgctggaaacagc

SEQ ID NO: 62294 - DNA, 70 bp, Artificial Sequence
  Synthetic
gccaagcatttaggtgacactatagcaccatcaaggaggaaggccgtttcagagctatgctggaaacagc

SEQ ID NO: 62295 - DNA, 70 bp, Artificial Sequence
  Synthetic
gccaagcatttaggtgacactatagctgtctctaggaatttccatgtttcagagctatgctggaaacagc

SEQ ID NO: 62296 - DNA, 70 bp, Artificial Sequence
  Synthetic
gccaagcatttaggtgacactataggaggaaggcctggttcttcagtttcagagctatgctggaaacagc

SEQ ID NO: 62297 - DNA, 70 bp, Artificial Sequence
  Synthetic
gccaagcatttaggtgacactatagggccttgtccaatcagtcaagtttcagagctatgctggaaacagc

SEQ ID NO: 62298 - DNA, 70 bp, Artificial Sequence
  Synthetic
gccaagcatttaggtgacactatagtggaatcagaacagagacttgtttcagagctatgctggaaacagc

SEQ ID NO: 62299 - DNA, 70 bp, Artificial Sequence
  Synthetic
gccaagcatttaggtgacactatagaattgtgtttttccaacaccgtttcagagctatgctggaaacagc

SEQ ID NO: 62300 - DNA, 70 bp, Artificial Sequence
  Synthetic
gccaagcatttaggtgacactatagctgggttataattcttcctcgtttcagagctatgctggaaacagc

SEQ ID NO: 62301 - DNA, 70 bp, Artificial Sequence
  Synthetic
gccaagcatttaggtgacactataggagcagagtgccacattacagtttcagagctatgctggaaacagc

SEQ ID NO: 62302 - DNA, 70 bp, Artificial Sequence
  Synthetic
gccaagcatttaggtgacactatagccctcactcttctcagctgagtttcagagctatgctggaaacagc

SEQ ID NO: 62303 - DNA, 70 bp, Artificial Sequence
  Synthetic
gccaagcatttaggtgacactatagggcctgagcctcagttaagagtttcagagctatgctggaaacagc

SEQ ID NO: 62304 - DNA, 70 bp, Artificial Sequence
  Synthetic
gccaagcatttaggtgacactatagtgcacttggaaactgtattcgtttcagagctatgctggaaacagc

SEQ ID NO: 62305 - DNA, 70 bp, Artificial Sequence
  Synthetic
gccaagcatttaggtgacactatagaatataaccactcaagctacgtttcagagctatgctggaaacagc

SEQ ID NO: 62306 - DNA, 70 bp, Artificial Sequence
  Synthetic
gccaagcatttaggtgacactatagccagaccagctggttatcaggtttcagagctatgctggaaacagc

SEQ ID NO: 62307 - DNA, 70 bp, Artificial Sequence
  Synthetic
gccaagcatttaggtgacactataggaggtcactgggaaatagctgtttcagagctatgctggaaacagc

SEQ ID NO: 62308 - DNA, 70 bp, Artificial Sequence
  Synthetic
gccaagcatttaggtgacactataggcggaagacagtgagggtgagtttcagagctatgctggaaacagc

SEQ ID NO: 62309 - DNA, 70 bp, Artificial Sequence
  Synthetic
gccaagcatttaggtgacactataggagtttggagtggaataagggtttcagagctatgctggaaacagc

SEQ ID NO: 62310 - DNA, 70 bp, Artificial Sequence
  Synthetic
gccaagcatttaggtgacactatagagtgaagaggacatgaataagtttcagagctatgctggaaacagc

SEQ ID NO: 62311 - DNA, 70 bp, Artificial Sequence
  Synthetic
gccaagcatttaggtgacactatagtgctgcaggaaagaatttaagtttcagagctatgctggaaacagc

SEQ ID NO: 62312 - DNA, 70 bp, Artificial Sequence
  Synthetic
gccaagcatttaggtgacactatagcgcacgccccctctctaggggtttcagagctatgctggaaacagc

SEQ ID NO: 62313 - DNA, 70 bp, Artificial Sequence
  Synthetic
gccaagcatttaggtgacactatagagcccaggaataagaagtaggtttcagagctatgctggaaacagc

SEQ ID NO: 62314 - DNA, 70 bp, Artificial Sequence
  Synthetic
gccaagcatttaggtgacactatagcccttgaggacgtcttagtcgtttcagagctatgctggaaacagc

SEQ ID NO: 62315 - DNA, 70 bp, Artificial Sequence
  Synthetic
gccaagcatttaggtgacactataggaaccgacaggtaactgagcgtttcagagctatgctggaaacagc

SEQ ID NO: 62316 - DNA, 70 bp, Artificial Sequence
  Synthetic
gccaagcatttaggtgacactataggccgtggtatcacctctagggtttcagagctatgctggaaacagc

SEQ ID NO: 62317 - DNA, 70 bp, Artificial Sequence
  Synthetic
gccaagcatttaggtgacactatagtacaggtctccatatcttgagtttcagagctatgctggaaacagc

SEQ ID NO: 62318 - DNA, 70 bp, Artificial Sequence
  Synthetic
gccaagcatttaggtgacactatagctcccctgcttcatcctcccgtttcagagctatgctggaaacagc

SEQ ID NO: 62319 - DNA, 70 bp, Artificial Sequence
  Synthetic
gccaagcatttaggtgacactatagtgcaaagtcaactagaagacgtttcagagctatgctggaaacagc

SEQ ID NO: 62320 - DNA, 70 bp, Artificial Sequence
  Synthetic
gccaagcatttaggtgacactatagtctggaaagccaagattcaagtttcagagctatgctggaaacagc

SEQ ID NO: 62321 - DNA, 70 bp, Artificial Sequence
  Synthetic
gccaagcatttaggtgacactatagctaagaaaggatttcttggcgtttcagagctatgctggaaacagc

SEQ ID NO: 62322 - DNA, 70 bp, Artificial Sequence
  Synthetic
gccaagcatttaggtgacactatagtacccgtgtgccagcgatgcgtttcagagctatgctggaaacagc

SEQ ID NO: 62323 - DNA, 70 bp, Artificial Sequence
  Synthetic
gccaagcatttaggtgacactatagttgagactggtttttacacagtttcagagctatgctggaaacagc

SEQ ID NO: 62324 - DNA, 70 bp, Artificial Sequence
  Synthetic
gccaagcatttaggtgacactatagcccaatcaaaaaacaacggcgtttcagagctatgctggaaacagc

SEQ ID NO: 62325 - DNA, 70 bp, Artificial Sequence
  Synthetic
gccaagcatttaggtgacactataggcatctttctctgattctctgtttcagagctatgctggaaacagc

SEQ ID NO: 62326 - DNA, 70 bp, Artificial Sequence
  Synthetic
gccaagcatttaggtgacactataggacccgggccaacgtggacagtttcagagctatgctggaaacagc

SEQ ID NO: 62327 - DNA, 70 bp, Artificial Sequence
  Synthetic
gccaagcatttaggtgacactatagggccacgcaggctgctcagagtttcagagctatgctggaaacagc

SEQ ID NO: 62328 - DNA, 70 bp, Artificial Sequence
  Synthetic
gccaagcatttaggtgacactatagggctcagccaataaatcctagtttcagagctatgctggaaacagc

SEQ ID NO: 62329 - DNA, 70 bp, Artificial Sequence
  Synthetic
gccaagcatttaggtgacactatagatttaatgatcggcatcagagtttcagagctatgctggaaacagc

SEQ ID NO: 62330 - DNA, 70 bp, Artificial Sequence
  Synthetic
gccaagcatttaggtgacactatagcagctactccctcagcggaagtttcagagctatgctggaaacagc

SEQ ID NO: 62331 - DNA, 70 bp, Artificial Sequence
  Synthetic
gccaagcatttaggtgacactatagacttcacttttccaggaggtgtttcagagctatgctggaaacagc

SEQ ID NO: 62332 - DNA, 70 bp, Artificial Sequence
  Synthetic
gccaagcatttaggtgacactatagttgccaagggcatcttctgagtttcagagctatgctggaaacagc

SEQ ID NO: 62333 - DNA, 70 bp, Artificial Sequence
  Synthetic
gccaagcatttaggtgacactatagggtgcccaggcttcaggcacgtttcagagctatgctggaaacagc

SEQ ID NO: 62334 - DNA, 70 bp, Artificial Sequence
  Synthetic
gccaagcatttaggtgacactatagtcaaatgacataaggtttgcgtttcagagctatgctggaaacagc

SEQ ID NO: 62335 - DNA, 70 bp, Artificial Sequence
  Synthetic
gccaagcatttaggtgacactatagtgctggtttctggtctcacagtttcagagctatgctggaaacagc

SEQ ID NO: 62336 - DNA, 70 bp, Artificial Sequence
  Synthetic
gccaagcatttaggtgacactatagctgccaaagtaacaaacaacgtttcagagctatgctggaaacagc

SEQ ID NO: 62337 - DNA, 70 bp, Artificial Sequence
  Synthetic
gccaagcatttaggtgacactatagggacacagacgcggatgatggtttcagagctatgctggaaacagc

SEQ ID NO: 62338 - DNA, 70 bp, Artificial Sequence
  Synthetic
gccaagcatttaggtgacactataggaggacttcgatgaagatgggtttcagagctatgctggaaacagc

SEQ ID NO: 62339 - DNA, 70 bp, Artificial Sequence
  Synthetic
gccaagcatttaggtgacactatagactgagggcattgtgtaggcgtttcagagctatgctggaaacagc

SEQ ID NO: 62340 - DNA, 70 bp, Artificial Sequence
  Synthetic
gccaagcatttaggtgacactatagcagtgaggcccaggcctagggtttcagagctatgctggaaacagc

SEQ ID NO: 62341 - DNA, 70 bp, Artificial Sequence
  Synthetic
gccaagcatttaggtgacactataggcaccgacacgctgctgtgagtttcagagctatgctggaaacagc

SEQ ID NO: 62342 - DNA, 70 bp, Artificial Sequence
  Synthetic
gccaagcatttaggtgacactatagggctccagcttcattctcacgtttcagagctatgctggaaacagc

SEQ ID NO: 62343 - DNA, 70 bp, Artificial Sequence
  Synthetic
gccaagcatttaggtgacactatagggagaccaaggaggatgctggtttcagagctatgctggaaacagc

SEQ ID NO: 62344 - DNA, 70 bp, Artificial Sequence
  Synthetic
gccaagcatttaggtgacactataggtgcaagtagtcatcaactcgtttcagagctatgctggaaacagc

SEQ ID NO: 62345 - DNA, 70 bp, Artificial Sequence
  Synthetic
gccaagcatttaggtgacactatagctcatcatgtcgagactgcagtttcagagctatgctggaaacagc

SEQ ID NO: 62346 - DNA, 70 bp, Artificial Sequence
  Synthetic
gccaagcatttaggtgacactatagtcttcgacaaacagacccttgtttcagagctatgctggaaacagc

SEQ ID NO: 62347 - DNA, 70 bp, Artificial Sequence
  Synthetic
gccaagcatttaggtgacactatagagacgaccgggagcacataggtttcagagctatgctggaaacagc

SEQ ID NO: 62348 - DNA, 70 bp, Artificial Sequence
  Synthetic
gccaagcatttaggtgacactatagagtaggtagtattcatgaacgtttcagagctatgctggaaacagc

SEQ ID NO: 62349 - DNA, 70 bp, Artificial Sequence
  Synthetic
gccaagcatttaggtgacactatagcgaaagctgtgatgagaatggtttcagagctatgctggaaacagc

SEQ ID NO: 62350 - DNA, 70 bp, Artificial Sequence
  Synthetic
gccaagcatttaggtgacactatagtcaaagtcacttcgaagccagtttcagagctatgctggaaacagc

SEQ ID NO: 62351 - DNA, 70 bp, Artificial Sequence
  Synthetic
gccaagcatttaggtgacactatagtgaacagcaggaagccttacgtttcagagctatgctggaaacagc

SEQ ID NO: 62352 - DNA, 70 bp, Artificial Sequence
  Synthetic
gccaagcatttaggtgacactatagatgtaggtagtcttccactggtttcagagctatgctggaaacagc

SEQ ID NO: 62353 - DNA, 70 bp, Artificial Sequence
  Synthetic
gccaagcatttaggtgacactatagtctgctgcagacgctgtacagtttcagagctatgctggaaacagc

SEQ ID NO: 62354 - DNA, 70 bp, Artificial Sequence
  Synthetic
gccaagcatttaggtgacactatagaggtaagcaagagatcagtcgtttcagagctatgctggaaacagc

SEQ ID NO: 62355 - DNA, 70 bp, Artificial Sequence
  Synthetic
gccaagcatttaggtgacactatagcagtgcttcagcgcctttacgtttcagagctatgctggaaacagc

SEQ ID NO: 62356 - DNA, 70 bp, Artificial Sequence
  Synthetic
gccaagcatttaggtgacactatagtggcaagcagcagatagctagtttcagagctatgctggaaacagc

SEQ ID NO: 62357 - DNA, 70 bp, Artificial Sequence
  Synthetic
gccaagcatttaggtgacactatagttcaatcagcccccgtaagggtttcagagctatgctggaaacagc

SEQ ID NO: 62358 - DNA, 70 bp, Artificial Sequence
  Synthetic
gccaagcatttaggtgacactataggaaatcatgtctgctgctctgtttcagagctatgctggaaacagc

SEQ ID NO: 62359 - DNA, 70 bp, Artificial Sequence
  Synthetic
gccaagcatttaggtgacactataggactttttgcgagccttcccgtttcagagctatgctggaaacagc

SEQ ID NO: 62360 - DNA, 70 bp, Artificial Sequence
  Synthetic
gccaagcatttaggtgacactatagtgagcagcacatgccccagcgtttcagagctatgctggaaacagc

SEQ ID NO: 62361 - DNA, 70 bp, Artificial Sequence
  Synthetic
gccaagcatttaggtgacactatagcagccatgccagctctggtggtttcagagctatgctggaaacagc

SEQ ID NO: 62362 - DNA, 70 bp, Artificial Sequence
  Synthetic
gccaagcatttaggtgacactatagcacagagcagagacttactggtttcagagctatgctggaaacagc

SEQ ID NO: 62363 - DNA, 70 bp, Artificial Sequence
  Synthetic
gccaagcatttaggtgacactatagatgttacatgcagaacagcagtttcagagctatgctggaaacagc

SEQ ID NO: 62364 - DNA, 70 bp, Artificial Sequence
  Synthetic
gccaagcatttaggtgacactataggcctgcgtgatcctctgagggtttcagagctatgctggaaacagc

SEQ ID NO: 62365 - DNA, 70 bp, Artificial Sequence
  Synthetic
gccaagcatttaggtgacactatagcaacactgatcttgcttctcgtttcagagctatgctggaaacagc

SEQ ID NO: 62366 - DNA, 70 bp, Artificial Sequence
  Synthetic
gccaagcatttaggtgacactatagagaccgggaagagaagacctgtttcagagctatgctggaaacagc

SEQ ID NO: 62367 - DNA, 70 bp, Artificial Sequence
  Synthetic
gccaagcatttaggtgacactataggaacaagtttctgctgtttggtttcagagctatgctggaaacagc

SEQ ID NO: 62368 - DNA, 70 bp, Artificial Sequence
  Synthetic
gccaagcatttaggtgacactatagcgagagctggagccatgagggtttcagagctatgctggaaacagc

SEQ ID NO: 62369 - DNA, 70 bp, Artificial Sequence
  Synthetic
gccaagcatttaggtgacactatagtgaaatgtctatggtcgacggtttcagagctatgctggaaacagc

SEQ ID NO: 62370 - DNA, 70 bp, Artificial Sequence
  Synthetic
gccaagcatttaggtgacactatagggcagtggggctcacacccggtttcagagctatgctggaaacagc

SEQ ID NO: 62371 - DNA, 70 bp, Artificial Sequence
  Synthetic
gccaagcatttaggtgacactatagcgcgattcaagtctaaaagggtttcagagctatgctggaaacagc

SEQ ID NO: 62372 - DNA, 70 bp, Artificial Sequence
  Synthetic
gccaagcatttaggtgacactataggctaatttggagaactgatcgtttcagagctatgctggaaacagc

SEQ ID NO: 62373 - DNA, 70 bp, Artificial Sequence
  Synthetic
gccaagcatttaggtgacactatagtcagtcacatctcctagtttgtttcagagctatgctggaaacagc

SEQ ID NO: 62374 - DNA, 70 bp, Artificial Sequence
  Synthetic
gccaagcatttaggtgacactatagtgtcacttcaagtacagaaagtttcagagctatgctggaaacagc

SEQ ID NO: 62375 - DNA, 70 bp, Artificial Sequence
  Synthetic
gccaagcatttaggtgacactatagcgagctctcctacaagctgggtttcagagctatgctggaaacagc

SEQ ID NO: 62376 - DNA, 70 bp, Artificial Sequence
  Synthetic
gccaagcatttaggtgacactatagctggaaacgaggcactcagtgtttcagagctatgctggaaacagc

SEQ ID NO: 62377 - DNA, 70 bp, Artificial Sequence
  Synthetic
gccaagcatttaggtgacactatagctatggtggctaccagtctcgtttcagagctatgctggaaacagc

SEQ ID NO: 62378 - DNA, 70 bp, Artificial Sequence
  Synthetic
gccaagcatttaggtgacactataggccaagacagggtcaagttagtttcagagctatgctggaaacagc

SEQ ID NO: 62379 - DNA, 70 bp, Artificial Sequence
  Synthetic
gccaagcatttaggtgacactataggccaggagtcatacaaagccgtttcagagctatgctggaaacagc

SEQ ID NO: 62380 - DNA, 70 bp, Artificial Sequence
  Synthetic
gccaagcatttaggtgacactatagcatgtggcgtgggcggtcacgtttcagagctatgctggaaacagc

SEQ ID NO: 62381 - DNA, 70 bp, Artificial Sequence
  Synthetic
gccaagcatttaggtgacactatagaaaatgtcttattgcacgaggtttcagagctatgctggaaacagc

SEQ ID NO: 62382 - DNA, 70 bp, Artificial Sequence
  Synthetic
gccaagcatttaggtgacactatagcctgggggccagggcaaagggtttcagagctatgctggaaacagc

SEQ ID NO: 62383 - DNA, 70 bp, Artificial Sequence
  Synthetic
gccaagcatttaggtgacactataggaagcctccggaactgaagagtttcagagctatgctggaaacagc

SEQ ID NO: 62384 - DNA, 70 bp, Artificial Sequence
  Synthetic
gccaagcatttaggtgacactataggctcactagtgtgaggcagtgtttcagagctatgctggaaacagc

SEQ ID NO: 62385 - DNA, 70 bp, Artificial Sequence
  Synthetic
gccaagcatttaggtgacactatagtgctggcttagctgcggggcgtttcagagctatgctggaaacagc

SEQ ID NO: 62386 - DNA, 70 bp, Artificial Sequence
  Synthetic
gccaagcatttaggtgacactatagttcaggctgtcgctttttttgtttcagagctatgctggaaacagc

SEQ ID NO: 62387 - DNA, 70 bp, Artificial Sequence
  Synthetic
gccaagcatttaggtgacactatagtgggaataaaacctgtccaagtttcagagctatgctggaaacagc

SEQ ID NO: 62388 - DNA, 70 bp, Artificial Sequence
  Synthetic
gccaagcatttaggtgacactataggccaatggaatgaaacttctgtttcagagctatgctggaaacagc

SEQ ID NO: 62389 - DNA, 70 bp, Artificial Sequence
  Synthetic
gccaagcatttaggtgacactatagttggaataacacctgtatgtgtttcagagctatgctggaaacagc

SEQ ID NO: 62390 - DNA, 70 bp, Artificial Sequence
  Synthetic
gccaagcatttaggtgacactatagaggctgctacctgacatcatgtttcagagctatgctggaaacagc

SEQ ID NO: 62391 - DNA, 70 bp, Artificial Sequence
  Synthetic
gccaagcatttaggtgacactatagtaagatgctttcccaacaatgtttcagagctatgctggaaacagc

SEQ ID NO: 62392 - DNA, 70 bp, Artificial Sequence
  Synthetic
gccaagcatttaggtgacactatagcgcgtcccgcagactttaaagtttcagagctatgctggaaacagc

SEQ ID NO: 62393 - DNA, 70 bp, Artificial Sequence
  Synthetic
gccaagcatttaggtgacactatagctcctggagctgcagacgtggtttcagagctatgctggaaacagc

SEQ ID NO: 62394 - DNA, 70 bp, Artificial Sequence
  Synthetic
gccaagcatttaggtgacactatagtagctctggcatttccttaggtttcagagctatgctggaaacagc

SEQ ID NO: 62395 - DNA, 70 bp, Artificial Sequence
  Synthetic
gccaagcatttaggtgacactatagcaaaaacagcagctgctgacgtttcagagctatgctggaaacagc

SEQ ID NO: 62396 - DNA, 70 bp, Artificial Sequence
  Synthetic
gccaagcatttaggtgacactataggggccctgattctcactcgtgtttcagagctatgctggaaacagc

SEQ ID NO: 62397 - DNA, 70 bp, Artificial Sequence
  Synthetic
gccaagcatttaggtgacactatagggcaggatgggcagctcagggtttcagagctatgctggaaacagc

SEQ ID NO: 62398 - DNA, 70 bp, Artificial Sequence
  Synthetic
gccaagcatttaggtgacactatagctggtcatctgcggcaacaagtttcagagctatgctggaaacagc

SEQ ID NO: 62399 - DNA, 70 bp, Artificial Sequence
  Synthetic
gccaagcatttaggtgacactatagggagcgctgcgtcatcagctgtttcagagctatgctggaaacagc

SEQ ID NO: 62400 - DNA, 70 bp, Artificial Sequence
  Synthetic
gccaagcatttaggtgacactatagccccagcatccctcgctcacgtttcagagctatgctggaaacagc

SEQ ID NO: 62401 - DNA, 70 bp, Artificial Sequence
  Synthetic
gccaagcatttaggtgacactatagttgcaacaattcttcatctggtttcagagctatgctggaaacagc

SEQ ID NO: 62402 - DNA, 70 bp, Artificial Sequence
  Synthetic
gccaagcatttaggtgacactatagcttctgaacagagcctgagggtttcagagctatgctggaaacagc

SEQ ID NO: 62403 - DNA, 70 bp, Artificial Sequence
  Synthetic
gccaagcatttaggtgacactatagtgtgttaaactctgcctaaggtttcagagctatgctggaaacagc

SEQ ID NO: 62404 - DNA, 70 bp, Artificial Sequence
  Synthetic
gccaagcatttaggtgacactatagtctttttctgtttggttctcgtttcagagctatgctggaaacagc

SEQ ID NO: 62405 - DNA, 70 bp, Artificial Sequence
  Synthetic
gccaagcatttaggtgacactataggggctgggctcagcttcagggtttcagagctatgctggaaacagc

SEQ ID NO: 62406 - DNA, 70 bp, Artificial Sequence
  Synthetic
gccaagcatttaggtgacactataggcaaggccagatcttcaagcgtttcagagctatgctggaaacagc

SEQ ID NO: 62407 - DNA, 70 bp, Artificial Sequence
  Synthetic
gccaagcatttaggtgacactatagggagccaaagatctgctccagtttcagagctatgctggaaacagc

SEQ ID NO: 62408 - DNA, 70 bp, Artificial Sequence
  Synthetic
gccaagcatttaggtgacactataggtcttagctcaaatggagcagtttcagagctatgctggaaacagc

SEQ ID NO: 62409 - DNA, 70 bp, Artificial Sequence
  Synthetic
gccaagcatttaggtgacactatagggtacagacggtggaggatggtttcagagctatgctggaaacagc

SEQ ID NO: 62410 - DNA, 70 bp, Artificial Sequence
  Synthetic
gccaagcatttaggtgacactatagagagaccagacaggatggtggtttcagagctatgctggaaacagc

SEQ ID NO: 62411 - DNA, 70 bp, Artificial Sequence
  Synthetic
gccaagcatttaggtgacactatagagatgtctaggaatccagctgtttcagagctatgctggaaacagc

SEQ ID NO: 62412 - DNA, 70 bp, Artificial Sequence
  Synthetic
gccaagcatttaggtgacactatagtattggttctcaaggagacggtttcagagctatgctggaaacagc

SEQ ID NO: 62413 - DNA, 70 bp, Artificial Sequence
  Synthetic
gccaagcatttaggtgacactatagctgtccgatcgggtcacatggtttcagagctatgctggaaacagc

SEQ ID NO: 62414 - DNA, 70 bp, Artificial Sequence
  Synthetic
gccaagcatttaggtgacactatagggcgcgcaggcgtcacatgagtttcagagctatgctggaaacagc

SEQ ID NO: 62415 - DNA, 70 bp, Artificial Sequence
  Synthetic
gccaagcatttaggtgacactatagtcaaagccccctctgcactggtttcagagctatgctggaaacagc

SEQ ID NO: 62416 - DNA, 70 bp, Artificial Sequence
  Synthetic
gccaagcatttaggtgacactatagagtgctcctcctgcttcagagtttcagagctatgctggaaacagc

SEQ ID NO: 62417 - DNA, 70 bp, Artificial Sequence
  Synthetic
gccaagcatttaggtgacactatagaagggcttcaagatcttctggtttcagagctatgctggaaacagc

SEQ ID NO: 62418 - DNA, 70 bp, Artificial Sequence
  Synthetic
gccaagcatttaggtgacactatagggggtacaagaggtcacccagtttcagagctatgctggaaacagc

SEQ ID NO: 62419 - DNA, 70 bp, Artificial Sequence
  Synthetic
gccaagcatttaggtgacactatagtgtgcgaatcccttgtgtaggtttcagagctatgctggaaacagc

SEQ ID NO: 62420 - DNA, 70 bp, Artificial Sequence
  Synthetic
gccaagcatttaggtgacactatagctcatggctcagattgttgcgtttcagagctatgctggaaacagc

SEQ ID NO: 62421 - DNA, 70 bp, Artificial Sequence
  Synthetic
gccaagcatttaggtgacactataggtgtggaagcctgattaaaggtttcagagctatgctggaaacagc

SEQ ID NO: 62422 - DNA, 70 bp, Artificial Sequence
  Synthetic
gccaagcatttaggtgacactataggctggtggaggccaagtaacgtttcagagctatgctggaaacagc

SEQ ID NO: 62423 - DNA, 70 bp, Artificial Sequence
  Synthetic
gccaagcatttaggtgacactatagccagggcaaacctgggtaacgtttcagagctatgctggaaacagc

SEQ ID NO: 62424 - DNA, 70 bp, Artificial Sequence
  Synthetic
gccaagcatttaggtgacactataggaagttctgaagttcagggagtttcagagctatgctggaaacagc

SEQ ID NO: 62425 - DNA, 70 bp, Artificial Sequence
  Synthetic
gccaagcatttaggtgacactatagcttctgcatctttatccatggtttcagagctatgctggaaacagc

SEQ ID NO: 62426 - DNA, 70 bp, Artificial Sequence
  Synthetic
gccaagcatttaggtgacactatagcactaggctgtcacagagccgtttcagagctatgctggaaacagc

SEQ ID NO: 62427 - DNA, 70 bp, Artificial Sequence
  Synthetic
gccaagcatttaggtgacactatagctccaggagttctgcgtcatgtttcagagctatgctggaaacagc

SEQ ID NO: 62428 - DNA, 70 bp, Artificial Sequence
  Synthetic
gccaagcatttaggtgacactatagtgtgggttgggaagtcagctgtttcagagctatgctggaaacagc

SEQ ID NO: 62429 - DNA, 70 bp, Artificial Sequence
  Synthetic
gccaagcatttaggtgacactatagtcacatgcagacattgaaaggtttcagagctatgctggaaacagc

SEQ ID NO: 62430 - DNA, 70 bp, Artificial Sequence
  Synthetic
gccaagcatttaggtgacactatagtgtcatacatatatgccttcgtttcagagctatgctggaaacagc

SEQ ID NO: 62431 - DNA, 70 bp, Artificial Sequence
  Synthetic
gccaagcatttaggtgacactatagcgaaacaacagtaggagatggtttcagagctatgctggaaacagc

SEQ ID NO: 62432 - DNA, 70 bp, Artificial Sequence
  Synthetic
gccaagcatttaggtgacactataggcggaagaggattttctaaggtttcagagctatgctggaaacagc

SEQ ID NO: 62433 - DNA, 70 bp, Artificial Sequence
  Synthetic
gccaagcatttaggtgacactataggggcacaggagcatattacagtttcagagctatgctggaaacagc

SEQ ID NO: 62434 - DNA, 70 bp, Artificial Sequence
  Synthetic
gccaagcatttaggtgacactatagacgttccccagtgcccctaggtttcagagctatgctggaaacagc

SEQ ID NO: 62435 - DNA, 70 bp, Artificial Sequence
  Synthetic
gccaagcatttaggtgacactatagtaaaaacgtttgtggagatggtttcagagctatgctggaaacagc

SEQ ID NO: 62436 - DNA, 70 bp, Artificial Sequence
  Synthetic
gccaagcatttaggtgacactatagtcaaacaaggaagagaaatggtttcagagctatgctggaaacagc

SEQ ID NO: 62437 - DNA, 70 bp, Artificial Sequence
  Synthetic
gccaagcatttaggtgacactatagacagagtgaaagccgtatcagtttcagagctatgctggaaacagc

SEQ ID NO: 62438 - DNA, 70 bp, Artificial Sequence
  Synthetic
gccaagcatttaggtgacactatagaattctctgatggctattgagtttcagagctatgctggaaacagc

SEQ ID NO: 62439 - DNA, 70 bp, Artificial Sequence
  Synthetic
gccaagcatttaggtgacactatagccttcctgggtgttagcatcgtttcagagctatgctggaaacagc

SEQ ID NO: 62440 - DNA, 70 bp, Artificial Sequence
  Synthetic
gccaagcatttaggtgacactataggcgtggatccagaaggacaagtttcagagctatgctggaaacagc

SEQ ID NO: 62441 - DNA, 70 bp, Artificial Sequence
  Synthetic
gccaagcatttaggtgacactataggaactcagccagcccttgacgtttcagagctatgctggaaacagc

SEQ ID NO: 62442 - DNA, 70 bp, Artificial Sequence
  Synthetic
gccaagcatttaggtgacactatagagcgaagggtaaagtgcagggtttcagagctatgctggaaacagc

SEQ ID NO: 62443 - DNA, 70 bp, Artificial Sequence
  Synthetic
gccaagcatttaggtgacactatagaagcaagcaggccggcctaagtttcagagctatgctggaaacagc

SEQ ID NO: 62444 - DNA, 70 bp, Artificial Sequence
  Synthetic
gccaagcatttaggtgacactataggcttttgtagttgccatcgcgtttcagagctatgctggaaacagc

SEQ ID NO: 62445 - DNA, 70 bp, Artificial Sequence
  Synthetic
gccaagcatttaggtgacactatagtgcaggcactgaagtggaatgtttcagagctatgctggaaacagc

SEQ ID NO: 62446 - DNA, 70 bp, Artificial Sequence
  Synthetic
gccaagcatttaggtgacactatagacatccgaactggagggacagtttcagagctatgctggaaacagc

SEQ ID NO: 62447 - DNA, 70 bp, Artificial Sequence
  Synthetic
gccaagcatttaggtgacactataggtcttctgctccttgcctttgtttcagagctatgctggaaacagc

SEQ ID NO: 62448 - DNA, 70 bp, Artificial Sequence
  Synthetic
gccaagcatttaggtgacactatagggctggctaggtctcctcccgtttcagagctatgctggaaacagc

SEQ ID NO: 62449 - DNA, 70 bp, Artificial Sequence
  Synthetic
gccaagcatttaggtgacactatagagaaatcatacagtctatgcgtttcagagctatgctggaaacagc

SEQ ID NO: 62450 - DNA, 70 bp, Artificial Sequence
  Synthetic
gccaagcatttaggtgacactatagctcctgggaaatgctacctcgtttcagagctatgctggaaacagc

SEQ ID NO: 62451 - DNA, 70 bp, Artificial Sequence
  Synthetic
gccaagcatttaggtgacactatagccccaccatctttagctcaggtttcagagctatgctggaaacagc

SEQ ID NO: 62452 - DNA, 70 bp, Artificial Sequence
  Synthetic
gccaagcatttaggtgacactatagcctggtgtggcaggggcagggtttcagagctatgctggaaacagc

SEQ ID NO: 62453 - DNA, 70 bp, Artificial Sequence
  Synthetic
gccaagcatttaggtgacactatagcggagcaagcagggagtagagtttcagagctatgctggaaacagc

SEQ ID NO: 62454 - DNA, 70 bp, Artificial Sequence
  Synthetic
gccaagcatttaggtgacactatagacttccaggcctctgctgtcgtttcagagctatgctggaaacagc

SEQ ID NO: 62455 - DNA, 70 bp, Artificial Sequence
  Synthetic
gccaagcatttaggtgacactatagcaaaacggttgtatccccctgtttcagagctatgctggaaacagc

SEQ ID NO: 62456 - DNA, 70 bp, Artificial Sequence
  Synthetic
gccaagcatttaggtgacactatagccagcccccacctacggcgtgtttcagagctatgctggaaacagc

SEQ ID NO: 62457 - DNA, 70 bp, Artificial Sequence
  Synthetic
gccaagcatttaggtgacactataggggtctcacgtcacttcagtgtttcagagctatgctggaaacagc

SEQ ID NO: 62458 - DNA, 70 bp, Artificial Sequence
  Synthetic
gccaagcatttaggtgacactatagcccgcggcgacctacagcatgtttcagagctatgctggaaacagc

SEQ ID NO: 62459 - DNA, 70 bp, Artificial Sequence
  Synthetic
gccaagcatttaggtgacactatagagcaatcaaaacagagtaaggtttcagagctatgctggaaacagc

SEQ ID NO: 62460 - DNA, 70 bp, Artificial Sequence
  Synthetic
gccaagcatttaggtgacactatagccttctaaggtaaggtgaatgtttcagagctatgctggaaacagc

SEQ ID NO: 62461 - DNA, 70 bp, Artificial Sequence
  Synthetic
gccaagcatttaggtgacactatagcgttttactgaaacgactacgtttcagagctatgctggaaacagc

SEQ ID NO: 62462 - DNA, 70 bp, Artificial Sequence
  Synthetic
gccaagcatttaggtgacactatagatacaagagactaacctcaggtttcagagctatgctggaaacagc

SEQ ID NO: 62463 - DNA, 70 bp, Artificial Sequence
  Synthetic
gccaagcatttaggtgacactatagcaagatgtagctaatgaccggtttcagagctatgctggaaacagc

SEQ ID NO: 62464 - DNA, 70 bp, Artificial Sequence
  Synthetic
gccaagcatttaggtgacactatagttgctcttgaagctgctcacgtttcagagctatgctggaaacagc

SEQ ID NO: 62465 - DNA, 70 bp, Artificial Sequence
  Synthetic
gccaagcatttaggtgacactatagtcttagactttcggaactttgtttcagagctatgctggaaacagc

SEQ ID NO: 62466 - DNA, 70 bp, Artificial Sequence
  Synthetic
gccaagcatttaggtgacactataggacttaaatgacaggcctatgtttcagagctatgctggaaacagc

SEQ ID NO: 62467 - DNA, 70 bp, Artificial Sequence
  Synthetic
gccaagcatttaggtgacactatagttaacttttcggggcccaacgtttcagagctatgctggaaacagc

SEQ ID NO: 62468 - DNA, 70 bp, Artificial Sequence
  Synthetic
gccaagcatttaggtgacactatagggctaccagcgccgcatgtagtttcagagctatgctggaaacagc

SEQ ID NO: 62469 - DNA, 70 bp, Artificial Sequence
  Synthetic
gccaagcatttaggtgacactataggccaggtcactttcaagagcgtttcagagctatgctggaaacagc

SEQ ID NO: 62470 - DNA, 70 bp, Artificial Sequence
  Synthetic
gccaagcatttaggtgacactatagatcgagtgtgacgtggtgaagtttcagagctatgctggaaacagc

SEQ ID NO: 62471 - DNA, 70 bp, Artificial Sequence
  Synthetic
gccaagcatttaggtgacactatagtggcgctgaccctgttataggtttcagagctatgctggaaacagc

SEQ ID NO: 62472 - DNA, 70 bp, Artificial Sequence
  Synthetic
gccaagcatttaggtgacactatagttgaacagcggatgaagatagtttcagagctatgctggaaacagc

SEQ ID NO: 62473 - DNA, 70 bp, Artificial Sequence
  Synthetic
gccaagcatttaggtgacactatagcaagctagaagaagaacacagtttcagagctatgctggaaacagc

SEQ ID NO: 62474 - DNA, 70 bp, Artificial Sequence
  Synthetic
gccaagcatttaggtgacactatagcaaattcagggtcttggattgtttcagagctatgctggaaacagc

SEQ ID NO: 62475 - DNA, 70 bp, Artificial Sequence
  Synthetic
gccaagcatttaggtgacactatagcatggaaatctcgaagatgagtttcagagctatgctggaaacagc

SEQ ID NO: 62476 - DNA, 70 bp, Artificial Sequence
  Synthetic
gccaagcatttaggtgacactatagcagacccttcagctgtgagcgtttcagagctatgctggaaacagc

SEQ ID NO: 62477 - DNA, 70 bp, Artificial Sequence
  Synthetic
gccaagcatttaggtgacactataggaatcgtgccacgcttcgaagtttcagagctatgctggaaacagc

SEQ ID NO: 62478 - DNA, 70 bp, Artificial Sequence
  Synthetic
gccaagcatttaggtgacactataggagtggtgacaaggtgctaggtttcagagctatgctggaaacagc

SEQ ID NO: 62479 - DNA, 70 bp, Artificial Sequence
  Synthetic
gccaagcatttaggtgacactatagacatggtctggggggtaaaggtttcagagctatgctggaaacagc

SEQ ID NO: 62480 - DNA, 70 bp, Artificial Sequence
  Synthetic
gccaagcatttaggtgacactataggatggctggtctattgcattgtttcagagctatgctggaaacagc

SEQ ID NO: 62481 - DNA, 70 bp, Artificial Sequence
  Synthetic
gccaagcatttaggtgacactatagacatcatctaaaatgctctggtttcagagctatgctggaaacagc

SEQ ID NO: 62482 - DNA, 70 bp, Artificial Sequence
  Synthetic
gccaagcatttaggtgacactatagaggacaatgaatctcgttctgtttcagagctatgctggaaacagc

SEQ ID NO: 62483 - DNA, 70 bp, Artificial Sequence
  Synthetic
gccaagcatttaggtgacactatagatgaatatgagtctcgctcagtttcagagctatgctggaaacagc

SEQ ID NO: 62484 - DNA, 70 bp, Artificial Sequence
  Synthetic
gccaagcatttaggtgacactatagctcttgcaaagaggagcaaagtttcagagctatgctggaaacagc

SEQ ID NO: 62485 - DNA, 70 bp, Artificial Sequence
  Synthetic
gccaagcatttaggtgacactatagggttatgaccgctactcagggtttcagagctatgctggaaacagc

SEQ ID NO: 62486 - DNA, 70 bp, Artificial Sequence
  Synthetic
gccaagcatttaggtgacactatagttaggactcactccacgatcgtttcagagctatgctggaaacagc

SEQ ID NO: 62487 - DNA, 70 bp, Artificial Sequence
  Synthetic
gccaagcatttaggtgacactatagaagaaaggacagaagaaaaggtttcagagctatgctggaaacagc

SEQ ID NO: 62488 - DNA, 70 bp, Artificial Sequence
  Synthetic
gccaagcatttaggtgacactataggcctgacaggatgcagtgaggtttcagagctatgctggaaacagc

SEQ ID NO: 62489 - DNA, 70 bp, Artificial Sequence
  Synthetic
gccaagcatttaggtgacactatagaagccgcggagcctccagacgtttcagagctatgctggaaacagc

SEQ ID NO: 62490 - DNA, 70 bp, Artificial Sequence
  Synthetic
gccaagcatttaggtgacactatagtggttccaagtagacgatgagtttcagagctatgctggaaacagc

SEQ ID NO: 62491 - DNA, 70 bp, Artificial Sequence
  Synthetic
gccaagcatttaggtgacactatagagcagtatgccgatcgggcggtttcagagctatgctggaaacagc

SEQ ID NO: 62492 - DNA, 70 bp, Artificial Sequence
  Synthetic
gccaagcatttaggtgacactatagtcagcatcttctgcttttccgtttcagagctatgctggaaacagc

SEQ ID NO: 62493 - DNA, 70 bp, Artificial Sequence
  Synthetic
gccaagcatttaggtgacactatagtgtgttatcaaggcccctgagtttcagagctatgctggaaacagc

SEQ ID NO: 62494 - DNA, 70 bp, Artificial Sequence
  Synthetic
gccaagcatttaggtgacactatagggtagcactacagaaattaggtttcagagctatgctggaaacagc

SEQ ID NO: 62495 - DNA, 70 bp, Artificial Sequence
  Synthetic
gccaagcatttaggtgacactatagtctctcatatcatgtgctacgtttcagagctatgctggaaacagc

SEQ ID NO: 62496 - DNA, 70 bp, Artificial Sequence
  Synthetic
gccaagcatttaggtgacactatagaagaagctgggcctgagatagtttcagagctatgctggaaacagc

SEQ ID NO: 62497 - DNA, 70 bp, Artificial Sequence
  Synthetic
gccaagcatttaggtgacactatagtcatgaccccttttttaaacgtttcagagctatgctggaaacagc

SEQ ID NO: 62498 - DNA, 70 bp, Artificial Sequence
  Synthetic
gccaagcatttaggtgacactataggaaaaactctgcttccagttgtttcagagctatgctggaaacagc

SEQ ID NO: 62499 - DNA, 70 bp, Artificial Sequence
  Synthetic
gccaagcatttaggtgacactatagggtgagacttaaagttatgcgtttcagagctatgctggaaacagc

SEQ ID NO: 62500 - DNA, 70 bp, Artificial Sequence
  Synthetic
gccaagcatttaggtgacactatagaagctcaagcaacatcagaagtttcagagctatgctggaaacagc

SEQ ID NO: 62501 - DNA, 70 bp, Artificial Sequence
  Synthetic
gccaagcatttaggtgacactatagtcagaagaaggaggcctgatgtttcagagctatgctggaaacagc

SEQ ID NO: 62502 - DNA, 70 bp, Artificial Sequence
  Synthetic
gccaagcatttaggtgacactatagtggacctgtgtagaagaattgtttcagagctatgctggaaacagc

SEQ ID NO: 62503 - DNA, 70 bp, Artificial Sequence
  Synthetic
gccaagcatttaggtgacactataggacgtctaccagacatactggtttcagagctatgctggaaacagc

SEQ ID NO: 62504 - DNA, 70 bp, Artificial Sequence
  Synthetic
gccaagcatttaggtgacactatagtgacttgtatgtacatcttcgtttcagagctatgctggaaacagc

SEQ ID NO: 62505 - DNA, 70 bp, Artificial Sequence
  Synthetic
gccaagcatttaggtgacactatagcttgacaacacagagtttcagtttcagagctatgctggaaacagc

SEQ ID NO: 62506 - DNA, 70 bp, Artificial Sequence
  Synthetic
gccaagcatttaggtgacactatagtttttaaaaggctgagtaccgtttcagagctatgctggaaacagc

SEQ ID NO: 62507 - DNA, 70 bp, Artificial Sequence
  Synthetic
gccaagcatttaggtgacactataggtttgcccggttcactgagagtttcagagctatgctggaaacagc

SEQ ID NO: 62508 - DNA, 70 bp, Artificial Sequence
  Synthetic
gccaagcatttaggtgacactatagtgactcttcgaacagcatctgtttcagagctatgctggaaacagc

SEQ ID NO: 62509 - DNA, 70 bp, Artificial Sequence
  Synthetic
gccaagcatttaggtgacactatagacagtagtagagatggaaaagtttcagagctatgctggaaacagc

SEQ ID NO: 62510 - DNA, 70 bp, Artificial Sequence
  Synthetic
gccaagcatttaggtgacactatagagaccggagacgtcgctgacgtttcagagctatgctggaaacagc

SEQ ID NO: 62511 - DNA, 70 bp, Artificial Sequence
  Synthetic
gccaagcatttaggtgacactatagggcaagtggtcaacagcagggtttcagagctatgctggaaacagc

SEQ ID NO: 62512 - DNA, 70 bp, Artificial Sequence
  Synthetic
gccaagcatttaggtgacactatagcccactgttacttgttgaacgtttcagagctatgctggaaacagc

SEQ ID NO: 62513 - DNA, 70 bp, Artificial Sequence
  Synthetic
gccaagcatttaggtgacactataggactgttggtaagaatatgcgtttcagagctatgctggaaacagc

SEQ ID NO: 62514 - DNA, 70 bp, Artificial Sequence
  Synthetic
gccaagcatttaggtgacactatagcccagacttacttagactgtgtttcagagctatgctggaaacagc

SEQ ID NO: 62515 - DNA, 70 bp, Artificial Sequence
  Synthetic
gccaagcatttaggtgacactataggattttgctcattatggtcggtttcagagctatgctggaaacagc

SEQ ID NO: 62516 - DNA, 70 bp, Artificial Sequence
  Synthetic
gccaagcatttaggtgacactataggaagtcttcagtgacgccaagtttcagagctatgctggaaacagc

SEQ ID NO: 62517 - DNA, 70 bp, Artificial Sequence
  Synthetic
gccaagcatttaggtgacactatagagccgatctgatagaggggggtttcagagctatgctggaaacagc

SEQ ID NO: 62518 - DNA, 70 bp, Artificial Sequence
  Synthetic
gccaagcatttaggtgacactatagggccggagcagatactaagcgtttcagagctatgctggaaacagc

SEQ ID NO: 62519 - DNA, 70 bp, Artificial Sequence
  Synthetic
gccaagcatttaggtgacactatagctcgtgtattactatatgcggtttcagagctatgctggaaacagc

SEQ ID NO: 62520 - DNA, 70 bp, Artificial Sequence
  Synthetic
gccaagcatttaggtgacactatagggggagagtcgatctgaaaagtttcagagctatgctggaaacagc

SEQ ID NO: 62521 - DNA, 70 bp, Artificial Sequence
  Synthetic
gccaagcatttaggtgacactataggtattcaagaaggtgcagtggtttcagagctatgctggaaacagc

SEQ ID NO: 62522 - DNA, 70 bp, Artificial Sequence
  Synthetic
gccaagcatttaggtgacactatagcaaaagtcagcacattcaaggtttcagagctatgctggaaacagc

SEQ ID NO: 62523 - DNA, 70 bp, Artificial Sequence
  Synthetic
gccaagcatttaggtgacactatagcatagatgaccgcaagtgcagtttcagagctatgctggaaacagc

SEQ ID NO: 62524 - DNA, 70 bp, Artificial Sequence
  Synthetic
gccaagcatttaggtgacactatagtgaacacttgacggcacaccgtttcagagctatgctggaaacagc

SEQ ID NO: 62525 - DNA, 70 bp, Artificial Sequence
  Synthetic
gccaagcatttaggtgacactatagcctatggggcccttccctacgtttcagagctatgctggaaacagc

SEQ ID NO: 62526 - DNA, 70 bp, Artificial Sequence
  Synthetic
gccaagcatttaggtgacactatagtacaggctgatcgtccacaagtttcagagctatgctggaaacagc

SEQ ID NO: 62527 - DNA, 70 bp, Artificial Sequence
  Synthetic
gccaagcatttaggtgacactatagctacactgtgcagtttgatggtttcagagctatgctggaaacagc

SEQ ID NO: 62528 - DNA, 70 bp, Artificial Sequence
  Synthetic
gccaagcatttaggtgacactatagcttcaggaaggtcagatagcgtttcagagctatgctggaaacagc

SEQ ID NO: 62529 - DNA, 70 bp, Artificial Sequence
  Synthetic
gccaagcatttaggtgacactatagtggatgtggatcaggctctcgtttcagagctatgctggaaacagc

SEQ ID NO: 62530 - DNA, 70 bp, Artificial Sequence
  Synthetic
gccaagcatttaggtgacactatagcggtagttaggataccactggtttcagagctatgctggaaacagc

SEQ ID NO: 62531 - DNA, 70 bp, Artificial Sequence
  Synthetic
gccaagcatttaggtgacactatagactagggtagaagagcccgtgtttcagagctatgctggaaacagc

SEQ ID NO: 62532 - DNA, 70 bp, Artificial Sequence
  Synthetic
gccaagcatttaggtgacactatagctaccgggcgcgcctaagtcgtttcagagctatgctggaaacagc

SEQ ID NO: 62533 - DNA, 70 bp, Artificial Sequence
  Synthetic
gccaagcatttaggtgacactatagaacatgggagctccctctgcgtttcagagctatgctggaaacagc

SEQ ID NO: 62534 - DNA, 70 bp, Artificial Sequence
  Synthetic
gccaagcatttaggtgacactatagatagtattcagcagaactgagtttcagagctatgctggaaacagc

SEQ ID NO: 62535 - DNA, 70 bp, Artificial Sequence
  Synthetic
gccaagcatttaggtgacactatagctgatagtgccagcctggccgtttcagagctatgctggaaacagc

SEQ ID NO: 62536 - DNA, 70 bp, Artificial Sequence
  Synthetic
gccaagcatttaggtgacactatagctgacaccacccagcaaggagtttcagagctatgctggaaacagc

SEQ ID NO: 62537 - DNA, 70 bp, Artificial Sequence
  Synthetic
gccaagcatttaggtgacactatagaccctggccaagcagaaggggtttcagagctatgctggaaacagc

SEQ ID NO: 62538 - DNA, 70 bp, Artificial Sequence
  Synthetic
gccaagcatttaggtgacactatagtccattggacaacagagagtgtttcagagctatgctggaaacagc

SEQ ID NO: 62539 - DNA, 70 bp, Artificial Sequence
  Synthetic
gccaagcatttaggtgacactatagaataatgactcccagagatcgtttcagagctatgctggaaacagc

SEQ ID NO: 62540 - DNA, 70 bp, Artificial Sequence
  Synthetic
gccaagcatttaggtgacactatagcaccaaaatgcactcagtaagtttcagagctatgctggaaacagc

SEQ ID NO: 62541 - DNA, 70 bp, Artificial Sequence
  Synthetic
gccaagcatttaggtgacactataggaagatggttaacagctgaagtttcagagctatgctggaaacagc

SEQ ID NO: 62542 - DNA, 70 bp, Artificial Sequence
  Synthetic
gccaagcatttaggtgacactataggtgcctagagaagaggattagtttcagagctatgctggaaacagc

SEQ ID NO: 62543 - DNA, 70 bp, Artificial Sequence
  Synthetic
gccaagcatttaggtgacactatagccgatccacctcagctgaacgtttcagagctatgctggaaacagc

SEQ ID NO: 62544 - DNA, 70 bp, Artificial Sequence
  Synthetic
gccaagcatttaggtgacactatagcgcagtctctctaacactgcgtttcagagctatgctggaaacagc

SEQ ID NO: 62545 - DNA, 70 bp, Artificial Sequence
  Synthetic
gccaagcatttaggtgacactataggaaggagcaggcagctcagtgtttcagagctatgctggaaacagc

SEQ ID NO: 62546 - DNA, 70 bp, Artificial Sequence
  Synthetic
gccaagcatttaggtgacactatagacctttgattgcgcgctgtggtttcagagctatgctggaaacagc

SEQ ID NO: 62547 - DNA, 70 bp, Artificial Sequence
  Synthetic
gccaagcatttaggtgacactatagctggggctcattcaacgctggtttcagagctatgctggaaacagc

SEQ ID NO: 62548 - DNA, 70 bp, Artificial Sequence
  Synthetic
gccaagcatttaggtgacactatagccttgcgcttcagttcttaagtttcagagctatgctggaaacagc

SEQ ID NO: 62549 - DNA, 70 bp, Artificial Sequence
  Synthetic
gccaagcatttaggtgacactatagctcgtggcgcctcctgtctggtttcagagctatgctggaaacagc

SEQ ID NO: 62550 - DNA, 70 bp, Artificial Sequence
  Synthetic
gccaagcatttaggtgacactatagtgcagtcagatatgatgcaggtttcagagctatgctggaaacagc

SEQ ID NO: 62551 - DNA, 70 bp, Artificial Sequence
  Synthetic
gccaagcatttaggtgacactatagacacgcacacaaactgacaggtttcagagctatgctggaaacagc

SEQ ID NO: 62552 - DNA, 70 bp, Artificial Sequence
  Synthetic
gccaagcatttaggtgacactatagatcagcaaagcaagcagagtgtttcagagctatgctggaaacagc

SEQ ID NO: 62553 - DNA, 70 bp, Artificial Sequence
  Synthetic
gccaagcatttaggtgacactatagggcaaacacgtcgtcagtgcgtttcagagctatgctggaaacagc

SEQ ID NO: 62554 - DNA, 70 bp, Artificial Sequence
  Synthetic
gccaagcatttaggtgacactatagtgactaataagactgtatgcgtttcagagctatgctggaaacagc

SEQ ID NO: 62555 - DNA, 70 bp, Artificial Sequence
  Synthetic
gccaagcatttaggtgacactatagcatcccccggaggtaatcaggtttcagagctatgctggaaacagc

SEQ ID NO: 62556 - DNA, 70 bp, Artificial Sequence
  Synthetic
gccaagcatttaggtgacactatagggaggtttagatgaatgactgtttcagagctatgctggaaacagc

SEQ ID NO: 62557 - DNA, 70 bp, Artificial Sequence
  Synthetic
gccaagcatttaggtgacactatagtctaggatgactcagctctggtttcagagctatgctggaaacagc

SEQ ID NO: 62558 - DNA, 70 bp, Artificial Sequence
  Synthetic
gccaagcatttaggtgacactatagggagtctccgggagcatcaggtttcagagctatgctggaaacagc

SEQ ID NO: 62559 - DNA, 70 bp, Artificial Sequence
  Synthetic
gccaagcatttaggtgacactatagacgtgtatgctgtggagaaagtttcagagctatgctggaaacagc

SEQ ID NO: 62560 - DNA, 70 bp, Artificial Sequence
  Synthetic
gccaagcatttaggtgacactatagggagcataggtcaggagcacgtttcagagctatgctggaaacagc

SEQ ID NO: 62561 - DNA, 70 bp, Artificial Sequence
  Synthetic
gccaagcatttaggtgacactatagtggaggacgtagaatttcacgtttcagagctatgctggaaacagc

SEQ ID NO: 62562 - DNA, 70 bp, Artificial Sequence
  Synthetic
gccaagcatttaggtgacactatagcttgtgatggttatcacttggtttcagagctatgctggaaacagc

SEQ ID NO: 62563 - DNA, 70 bp, Artificial Sequence
  Synthetic
gccaagcatttaggtgacactatagaagccaagctaccaattacggtttcagagctatgctggaaacagc

SEQ ID NO: 62564 - DNA, 70 bp, Artificial Sequence
  Synthetic
gccaagcatttaggtgacactatagaccagtgaagccacagattagtttcagagctatgctggaaacagc

SEQ ID NO: 62565 - DNA, 70 bp, Artificial Sequence
  Synthetic
gccaagcatttaggtgacactataggcggtgctcacagctcatcggtttcagagctatgctggaaacagc

SEQ ID NO: 62566 - DNA, 70 bp, Artificial Sequence
  Synthetic
gccaagcatttaggtgacactatagaaagccaccagtttctcagggtttcagagctatgctggaaacagc

SEQ ID NO: 62567 - DNA, 70 bp, Artificial Sequence
  Synthetic
gccaagcatttaggtgacactatagggacgtcagggctcagagtggtttcagagctatgctggaaacagc

SEQ ID NO: 62568 - DNA, 70 bp, Artificial Sequence
  Synthetic
gccaagcatttaggtgacactatagcggggtggcatggaattagcgtttcagagctatgctggaaacagc

SEQ ID NO: 62569 - DNA, 70 bp, Artificial Sequence
  Synthetic
gccaagcatttaggtgacactatagagaggaggtgtgtttgtgtagtttcagagctatgctggaaacagc

SEQ ID NO: 62570 - DNA, 70 bp, Artificial Sequence
  Synthetic
gccaagcatttaggtgacactatagcaacagccaccatcacttatgtttcagagctatgctggaaacagc

SEQ ID NO: 62571 - DNA, 70 bp, Artificial Sequence
  Synthetic
gccaagcatttaggtgacactatagttcttcacattttagtgtccgtttcagagctatgctggaaacagc

SEQ ID NO: 62572 - DNA, 70 bp, Artificial Sequence
  Synthetic
gccaagcatttaggtgacactataggtttgagcctcaaaaagtgagtttcagagctatgctggaaacagc

SEQ ID NO: 62573 - DNA, 70 bp, Artificial Sequence
  Synthetic
gccaagcatttaggtgacactataggggaagcggccggggtcagtgtttcagagctatgctggaaacagc

SEQ ID NO: 62574 - DNA, 70 bp, Artificial Sequence
  Synthetic
gccaagcatttaggtgacactatagtagatgggtgataatatggtgtttcagagctatgctggaaacagc

SEQ ID NO: 62575 - DNA, 70 bp, Artificial Sequence
  Synthetic
gccaagcatttaggtgacactatagacatacacttgtccgctcctgtttcagagctatgctggaaacagc

SEQ ID NO: 62576 - DNA, 70 bp, Artificial Sequence
  Synthetic
gccaagcatttaggtgacactataggggcctcccaatagactaacgtttcagagctatgctggaaacagc

SEQ ID NO: 62577 - DNA, 70 bp, Artificial Sequence
  Synthetic
gccaagcatttaggtgacactatagaggaatccggtgggagtagcgtttcagagctatgctggaaacagc

SEQ ID NO: 62578 - DNA, 70 bp, Artificial Sequence
  Synthetic
gccaagcatttaggtgacactatagaatctgctccagaggttatcgtttcagagctatgctggaaacagc

SEQ ID NO: 62579 - DNA, 70 bp, Artificial Sequence
  Synthetic
gccaagcatttaggtgacactataggatggttggcctgctaaaatgtttcagagctatgctggaaacagc

SEQ ID NO: 62580 - DNA, 70 bp, Artificial Sequence
  Synthetic
gccaagcatttaggtgacactatagaccttagcttcatagagcctgtttcagagctatgctggaaacagc

SEQ ID NO: 62581 - DNA, 70 bp, Artificial Sequence
  Synthetic
gccaagcatttaggtgacactataggctggattcagtagactgctgtttcagagctatgctggaaacagc

SEQ ID NO: 62582 - DNA, 70 bp, Artificial Sequence
  Synthetic
gccaagcatttaggtgacactatagaagctctgttctgctcatctgtttcagagctatgctggaaacagc

SEQ ID NO: 62583 - DNA, 70 bp, Artificial Sequence
  Synthetic
gccaagcatttaggtgacactatagactgaaactgaagtacttcagtttcagagctatgctggaaacagc

SEQ ID NO: 62584 - DNA, 70 bp, Artificial Sequence
  Synthetic
gccaagcatttaggtgacactatagcagaaatgctagtcaagttcgtttcagagctatgctggaaacagc

SEQ ID NO: 62585 - DNA, 70 bp, Artificial Sequence
  Synthetic
gccaagcatttaggtgacactataggggctgtcttccttttcatagtttcagagctatgctggaaacagc

SEQ ID NO: 62586 - DNA, 70 bp, Artificial Sequence
  Synthetic
gccaagcatttaggtgacactatagactctgcgacagattcgacagtttcagagctatgctggaaacagc

SEQ ID NO: 62587 - DNA, 70 bp, Artificial Sequence
  Synthetic
gccaagcatttaggtgacactatagacatttgctttatgctgcttgtttcagagctatgctggaaacagc

SEQ ID NO: 62588 - DNA, 70 bp, Artificial Sequence
  Synthetic
gccaagcatttaggtgacactatagaaggaactgaaaaagctggcgtttcagagctatgctggaaacagc

SEQ ID NO: 62589 - DNA, 70 bp, Artificial Sequence
  Synthetic
gccaagcatttaggtgacactatagtaaatggactctaacctcaggtttcagagctatgctggaaacagc

SEQ ID NO: 62590 - DNA, 70 bp, Artificial Sequence
  Synthetic
gccaagcatttaggtgacactatagttatccaatgaggaacccaagtttcagagctatgctggaaacagc

SEQ ID NO: 62591 - DNA, 70 bp, Artificial Sequence
  Synthetic
gccaagcatttaggtgacactataggccttgccttgcacttgctcgtttcagagctatgctggaaacagc

SEQ ID NO: 62592 - DNA, 70 bp, Artificial Sequence
  Synthetic
gccaagcatttaggtgacactatagttataaatctggtcacctctgtttcagagctatgctggaaacagc

SEQ ID NO: 62593 - DNA, 70 bp, Artificial Sequence
  Synthetic
gccaagcatttaggtgacactataggcaaacatgcttcagcaatcgtttcagagctatgctggaaacagc

SEQ ID NO: 62594 - DNA, 70 bp, Artificial Sequence
  Synthetic
gccaagcatttaggtgacactatagccccaatgcagtgcagtcaggtttcagagctatgctggaaacagc

SEQ ID NO: 62595 - DNA, 70 bp, Artificial Sequence
  Synthetic
gccaagcatttaggtgacactatagagccagcagttggtcatctcgtttcagagctatgctggaaacagc

SEQ ID NO: 62596 - DNA, 70 bp, Artificial Sequence
  Synthetic
gccaagcatttaggtgacactatagtcaggttgtgtccaggcatggtttcagagctatgctggaaacagc

SEQ ID NO: 62597 - DNA, 70 bp, Artificial Sequence
  Synthetic
gccaagcatttaggtgacactatagtgaccttctgtgaagaactggtttcagagctatgctggaaacagc

SEQ ID NO: 62598 - DNA, 70 bp, Artificial Sequence
  Synthetic
gccaagcatttaggtgacactatagcgagatcgaaggattctagggtttcagagctatgctggaaacagc

SEQ ID NO: 62599 - DNA, 70 bp, Artificial Sequence
  Synthetic
gccaagcatttaggtgacactataggttggctcatctcactcacggtttcagagctatgctggaaacagc

SEQ ID NO: 62600 - DNA, 70 bp, Artificial Sequence
  Synthetic
gccaagcatttaggtgacactatagaagaagaagacctctggcgggtttcagagctatgctggaaacagc

SEQ ID NO: 62601 - DNA, 70 bp, Artificial Sequence
  Synthetic
gccaagcatttaggtgacactatagaaccaccaaaggccgcaaaggtttcagagctatgctggaaacagc

SEQ ID NO: 62602 - DNA, 70 bp, Artificial Sequence
  Synthetic
gccaagcatttaggtgacactatagaggctctggctgcggattaggtttcagagctatgctggaaacagc

SEQ ID NO: 62603 - DNA, 70 bp, Artificial Sequence
  Synthetic
gccaagcatttaggtgacactatagccctcagacgtggacagctagtttcagagctatgctggaaacagc

SEQ ID NO: 62604 - DNA, 70 bp, Artificial Sequence
  Synthetic
gccaagcatttaggtgacactatagtgactcctgctgatggttaagtttcagagctatgctggaaacagc

SEQ ID NO: 62605 - DNA, 70 bp, Artificial Sequence
  Synthetic
gccaagcatttaggtgacactatagaaagctaccgtgaatttactgtttcagagctatgctggaaacagc

SEQ ID NO: 62606 - DNA, 70 bp, Artificial Sequence
  Synthetic
gccaagcatttaggtgacactataggaaacacctggcctgctagggtttcagagctatgctggaaacagc

SEQ ID NO: 62607 - DNA, 70 bp, Artificial Sequence
  Synthetic
gccaagcatttaggtgacactataggcaggtcctggcccgtagccgtttcagagctatgctggaaacagc

SEQ ID NO: 62608 - DNA, 70 bp, Artificial Sequence
  Synthetic
gccaagcatttaggtgacactatagtctgcaagttcaaaaactaggtttcagagctatgctggaaacagc

SEQ ID NO: 62609 - DNA, 70 bp, Artificial Sequence
  Synthetic
gccaagcatttaggtgacactataggcaagcctgacttcatgctcgtttcagagctatgctggaaacagc

SEQ ID NO: 62610 - DNA, 70 bp, Artificial Sequence
  Synthetic
gccaagcatttaggtgacactataggtcagtgaacttgcagacatgtttcagagctatgctggaaacagc

SEQ ID NO: 62611 - DNA, 70 bp, Artificial Sequence
  Synthetic
gccaagcatttaggtgacactataggtctgcaagttcaaggactagtttcagagctatgctggaaacagc

SEQ ID NO: 62612 - DNA, 70 bp, Artificial Sequence
  Synthetic
gccaagcatttaggtgacactatagacaagcacatacggatacatgtttcagagctatgctggaaacagc

SEQ ID NO: 62613 - DNA, 70 bp, Artificial Sequence
  Synthetic
gccaagcatttaggtgacactatagcttgattcttgctctatggtgtttcagagctatgctggaaacagc

SEQ ID NO: 62614 - DNA, 70 bp, Artificial Sequence
  Synthetic
gccaagcatttaggtgacactatagagtactaatccaaacagtcagtttcagagctatgctggaaacagc

SEQ ID NO: 62615 - DNA, 70 bp, Artificial Sequence
  Synthetic
gccaagcatttaggtgacactatagagtcagatcagctcctaagggtttcagagctatgctggaaacagc

SEQ ID NO: 62616 - DNA, 70 bp, Artificial Sequence
  Synthetic
gccaagcatttaggtgacactatagtctggcatcgcggggctacggtttcagagctatgctggaaacagc

SEQ ID NO: 62617 - DNA, 70 bp, Artificial Sequence
  Synthetic
gccaagcatttaggtgacactatagcctgtgaagagagaacgcaggtttcagagctatgctggaaacagc

SEQ ID NO: 62618 - DNA, 70 bp, Artificial Sequence
  Synthetic
gccaagcatttaggtgacactatagtgtctctaccacagggagcagtttcagagctatgctggaaacagc

SEQ ID NO: 62619 - DNA, 70 bp, Artificial Sequence
  Synthetic
gccaagcatttaggtgacactatagacagaagacgaaggtcacttgtttcagagctatgctggaaacagc

SEQ ID NO: 62620 - DNA, 70 bp, Artificial Sequence
  Synthetic
gccaagcatttaggtgacactataggagcaacctggtcatctgaggtttcagagctatgctggaaacagc

SEQ ID NO: 62621 - DNA, 70 bp, Artificial Sequence
  Synthetic
gccaagcatttaggtgacactataggggcggggggcttcagagcagtttcagagctatgctggaaacagc

SEQ ID NO: 62622 - DNA, 70 bp, Artificial Sequence
  Synthetic
gccaagcatttaggtgacactatagccgcggctcagagcaccgaggtttcagagctatgctggaaacagc

SEQ ID NO: 62623 - DNA, 70 bp, Artificial Sequence
  Synthetic
gccaagcatttaggtgacactatagtgggtggcagagggcctcaggtttcagagctatgctggaaacagc

SEQ ID NO: 62624 - DNA, 70 bp, Artificial Sequence
  Synthetic
gccaagcatttaggtgacactatagcctgccgaggcgcggaataagtttcagagctatgctggaaacagc

SEQ ID NO: 62625 - DNA, 70 bp, Artificial Sequence
  Synthetic
gccaagcatttaggtgacactatagtatatcagcattctctgactgtttcagagctatgctggaaacagc

SEQ ID NO: 62626 - DNA, 70 bp, Artificial Sequence
  Synthetic
gccaagcatttaggtgacactatagaagaagcacgatgtctgagagtttcagagctatgctggaaacagc

SEQ ID NO: 62627 - DNA, 70 bp, Artificial Sequence
  Synthetic
gccaagcatttaggtgacactataggttaacggcaattggcttatgtttcagagctatgctggaaacagc

SEQ ID NO: 62628 - DNA, 70 bp, Artificial Sequence
  Synthetic
gccaagcatttaggtgacactataggggggtcacaacacagtgacgtttcagagctatgctggaaacagc

SEQ ID NO: 62629 - DNA, 70 bp, Artificial Sequence
  Synthetic
gccaagcatttaggtgacactataggcctcagtcccgcttctagcgtttcagagctatgctggaaacagc

SEQ ID NO: 62630 - DNA, 70 bp, Artificial Sequence
  Synthetic
gccaagcatttaggtgacactatagtggtggccacctaccaagtcgtttcagagctatgctggaaacagc

SEQ ID NO: 62631 - DNA, 70 bp, Artificial Sequence
  Synthetic
gccaagcatttaggtgacactataggctcaccaaaatcagtagttgtttcagagctatgctggaaacagc

SEQ ID NO: 62632 - DNA, 70 bp, Artificial Sequence
  Synthetic
gccaagcatttaggtgacactatagtcccagtggatctaaatcaagtttcagagctatgctggaaacagc

SEQ ID NO: 62633 - DNA, 70 bp, Artificial Sequence
  Synthetic
gccaagcatttaggtgacactatagatgaggtctcaatcagccacgtttcagagctatgctggaaacagc

SEQ ID NO: 62634 - DNA, 70 bp, Artificial Sequence
  Synthetic
gccaagcatttaggtgacactatagtgaagaagcagctcaagggcgtttcagagctatgctggaaacagc

SEQ ID NO: 62635 - DNA, 70 bp, Artificial Sequence
  Synthetic
gccaagcatttaggtgacactatagaccctcagcggcaaaattaagtttcagagctatgctggaaacagc

SEQ ID NO: 62636 - DNA, 70 bp, Artificial Sequence
  Synthetic
gccaagcatttaggtgacactatagctcgagccctcccttccacagtttcagagctatgctggaaacagc

SEQ ID NO: 62637 - DNA, 70 bp, Artificial Sequence
  Synthetic
gccaagcatttaggtgacactatagtgctgtcgtgtgcagccctggtttcagagctatgctggaaacagc

SEQ ID NO: 62638 - DNA, 70 bp, Artificial Sequence
  Synthetic
gccaagcatttaggtgacactatagtgctgccacctgacctgacagtttcagagctatgctggaaacagc

SEQ ID NO: 62639 - DNA, 70 bp, Artificial Sequence
  Synthetic
gccaagcatttaggtgacactatagttcctttcaaatctgctggggtttcagagctatgctggaaacagc

SEQ ID NO: 62640 - DNA, 70 bp, Artificial Sequence
  Synthetic
gccaagcatttaggtgacactataggctggctcatggctctgccagtttcagagctatgctggaaacagc

SEQ ID NO: 62641 - DNA, 70 bp, Artificial Sequence
  Synthetic
gccaagcatttaggtgacactatagaaaaggagtctctgcctcaggtttcagagctatgctggaaacagc

SEQ ID NO: 62642 - DNA, 70 bp, Artificial Sequence
  Synthetic
gccaagcatttaggtgacactatagaattctttttcttctgtgccgtttcagagctatgctggaaacagc

SEQ ID NO: 62643 - DNA, 70 bp, Artificial Sequence
  Synthetic
gccaagcatttaggtgacactatagaagtttgttgtaaaaccaccgtttcagagctatgctggaaacagc

SEQ ID NO: 62644 - DNA, 70 bp, Artificial Sequence
  Synthetic
gccaagcatttaggtgacactatagaaaactggtctaataactgcgtttcagagctatgctggaaacagc

SEQ ID NO: 62645 - DNA, 70 bp, Artificial Sequence
  Synthetic
gccaagcatttaggtgacactatagcctggggagccgccatcactgtttcagagctatgctggaaacagc

SEQ ID NO: 62646 - DNA, 70 bp, Artificial Sequence
  Synthetic
gccaagcatttaggtgacactatagggcgggcaggcgtcatcgctgtttcagagctatgctggaaacagc

SEQ ID NO: 62647 - DNA, 70 bp, Artificial Sequence
  Synthetic
gccaagcatttaggtgacactatagtgataactggcatcaactcagtttcagagctatgctggaaacagc

SEQ ID NO: 62648 - DNA, 70 bp, Artificial Sequence
  Synthetic
gccaagcatttaggtgacactataggctaggcgtcgtcactgcaggtttcagagctatgctggaaacagc

SEQ ID NO: 62649 - DNA, 70 bp, Artificial Sequence
  Synthetic
gccaagcatttaggtgacactatagccaggcctgtgttcgtgagtgtttcagagctatgctggaaacagc

SEQ ID NO: 62650 - DNA, 70 bp, Artificial Sequence
  Synthetic
gccaagcatttaggtgacactatagaaggagcccagaaaaggaaagtttcagagctatgctggaaacagc

SEQ ID NO: 62651 - DNA, 70 bp, Artificial Sequence
  Synthetic
gccaagcatttaggtgacactatagagtgaagtctctgctctaacgtttcagagctatgctggaaacagc

SEQ ID NO: 62652 - DNA, 70 bp, Artificial Sequence
  Synthetic
gccaagcatttaggtgacactatagagaagctgtgacatattctggtttcagagctatgctggaaacagc

SEQ ID NO: 62653 - DNA, 70 bp, Artificial Sequence
  Synthetic
gccaagcatttaggtgacactatagttcatggaggatggattggagtttcagagctatgctggaaacagc

SEQ ID NO: 62654 - DNA, 70 bp, Artificial Sequence
  Synthetic
gccaagcatttaggtgacactataggctgcatcacagttgcacaagtttcagagctatgctggaaacagc

SEQ ID NO: 62655 - DNA, 70 bp, Artificial Sequence
  Synthetic
gccaagcatttaggtgacactatagcagagacctgattgttgcaggtttcagagctatgctggaaacagc

SEQ ID NO: 62656 - DNA, 70 bp, Artificial Sequence
  Synthetic
gccaagcatttaggtgacactatagaattactttgaagtctccaggtttcagagctatgctggaaacagc

SEQ ID NO: 62657 - DNA, 70 bp, Artificial Sequence
  Synthetic
gccaagcatttaggtgacactatagccgatgcaagctctcaggacgtttcagagctatgctggaaacagc

SEQ ID NO: 62658 - DNA, 70 bp, Artificial Sequence
  Synthetic
gccaagcatttaggtgacactatagcaaagttcttttctggtctcgtttcagagctatgctggaaacagc

SEQ ID NO: 62659 - DNA, 70 bp, Artificial Sequence
  Synthetic
gccaagcatttaggtgacactatagtgggtcagcattcatcagaggtttcagagctatgctggaaacagc

SEQ ID NO: 62660 - DNA, 70 bp, Artificial Sequence
  Synthetic
gccaagcatttaggtgacactataggggtggttggtgtcaccgaggtttcagagctatgctggaaacagc

SEQ ID NO: 62661 - DNA, 70 bp, Artificial Sequence
  Synthetic
gccaagcatttaggtgacactatagttttgcagtgggggcttattgtttcagagctatgctggaaacagc

SEQ ID NO: 62662 - DNA, 70 bp, Artificial Sequence
  Synthetic
gccaagcatttaggtgacactatagttttggagtgagggcttattgtttcagagctatgctggaaacagc

SEQ ID NO: 62663 - DNA, 70 bp, Artificial Sequence
  Synthetic
gccaagcatttaggtgacactatagttttgcagtggcggcttattgtttcagagctatgctggaaacagc

SEQ ID NO: 62664 - DNA, 70 bp, Artificial Sequence
  Synthetic
gccaagcatttaggtgacactatagagtgccccagtttcttctgagtttcagagctatgctggaaacagc

SEQ ID NO: 62665 - DNA, 70 bp, Artificial Sequence
  Synthetic
gccaagcatttaggtgacactatagggaagggctgactttctcatgtttcagagctatgctggaaacagc

SEQ ID NO: 62666 - DNA, 70 bp, Artificial Sequence
  Synthetic
gccaagcatttaggtgacactatagtgtcattttgtcagtgcgtcgtttcagagctatgctggaaacagc

SEQ ID NO: 62667 - DNA, 70 bp, Artificial Sequence
  Synthetic
gccaagcatttaggtgacactatagggaagtcagagagcttggtagtttcagagctatgctggaaacagc

SEQ ID NO: 62668 - DNA, 70 bp, Artificial Sequence
  Synthetic
gccaagcatttaggtgacactatagtcaggaagatggagtgactcgtttcagagctatgctggaaacagc

SEQ ID NO: 62669 - DNA, 70 bp, Artificial Sequence
  Synthetic
gccaagcatttaggtgacactatagggtgctagaattggtatgaagtttcagagctatgctggaaacagc

SEQ ID NO: 62670 - DNA, 70 bp, Artificial Sequence
  Synthetic
gccaagcatttaggtgacactataggatggtccacatctataagtgtttcagagctatgctggaaacagc

SEQ ID NO: 62671 - DNA, 70 bp, Artificial Sequence
  Synthetic
gccaagcatttaggtgacactatagggggaggccaagggcttagcgtttcagagctatgctggaaacagc

SEQ ID NO: 62672 - DNA, 70 bp, Artificial Sequence
  Synthetic
gccaagcatttaggtgacactatagggggctgctagatgccctgcgtttcagagctatgctggaaacagc

SEQ ID NO: 62673 - DNA, 70 bp, Artificial Sequence
  Synthetic
gccaagcatttaggtgacactatagactcagccatgaaaatgaatgtttcagagctatgctggaaacagc

SEQ ID NO: 62674 - DNA, 70 bp, Artificial Sequence
  Synthetic
gccaagcatttaggtgacactatagctcagagccaggagggactggtttcagagctatgctggaaacagc

SEQ ID NO: 62675 - DNA, 70 bp, Artificial Sequence
  Synthetic
gccaagcatttaggtgacactatagtattctttagactgcagtgtgtttcagagctatgctggaaacagc

SEQ ID NO: 62676 - DNA, 70 bp, Artificial Sequence
  Synthetic
gccaagcatttaggtgacactatagcggagaggcctctacaggatgtttcagagctatgctggaaacagc

SEQ ID NO: 62677 - DNA, 70 bp, Artificial Sequence
  Synthetic
gccaagcatttaggtgacactatagtccccacagacctgtatcatgtttcagagctatgctggaaacagc

SEQ ID NO: 62678 - DNA, 70 bp, Artificial Sequence
  Synthetic
gccaagcatttaggtgacactatagttcatgggaacagcagctgggtttcagagctatgctggaaacagc

SEQ ID NO: 62679 - DNA, 70 bp, Artificial Sequence
  Synthetic
gccaagcatttaggtgacactatagccatcctactgttgaaatgtgtttcagagctatgctggaaacagc

SEQ ID NO: 62680 - DNA, 70 bp, Artificial Sequence
  Synthetic
gccaagcatttaggtgacactataggccctcataaccctaaaagagtttcagagctatgctggaaacagc

SEQ ID NO: 62681 - DNA, 70 bp, Artificial Sequence
  Synthetic
gccaagcatttaggtgacactatagtgcccgctgaccctgagtgagtttcagagctatgctggaaacagc

SEQ ID NO: 62682 - DNA, 70 bp, Artificial Sequence
  Synthetic
gccaagcatttaggtgacactatagttccaggaacatcaatgtgagtttcagagctatgctggaaacagc

SEQ ID NO: 62683 - DNA, 70 bp, Artificial Sequence
  Synthetic
gccaagcatttaggtgacactatagtttgtcaagatcagcaatgagtttcagagctatgctggaaacagc

SEQ ID NO: 62684 - DNA, 70 bp, Artificial Sequence
  Synthetic
gccaagcatttaggtgacactatagccactggtccctcccttcaggtttcagagctatgctggaaacagc

SEQ ID NO: 62685 - DNA, 70 bp, Artificial Sequence
  Synthetic
gccaagcatttaggtgacactataggcacgggcactgttctgagggtttcagagctatgctggaaacagc

SEQ ID NO: 62686 - DNA, 70 bp, Artificial Sequence
  Synthetic
gccaagcatttaggtgacactatagaggacagggctgcctcagctgtttcagagctatgctggaaacagc

SEQ ID NO: 62687 - DNA, 70 bp, Artificial Sequence
  Synthetic
gccaagcatttaggtgacactataggagcccgaaaacccgtaggcgtttcagagctatgctggaaacagc

SEQ ID NO: 62688 - DNA, 70 bp, Artificial Sequence
  Synthetic
gccaagcatttaggtgacactataggggacttttgtgagtcaggcgtttcagagctatgctggaaacagc

SEQ ID NO: 62689 - DNA, 70 bp, Artificial Sequence
  Synthetic
gccaagcatttaggtgacactatagctacgcgtctagcagaacacgtttcagagctatgctggaaacagc

SEQ ID NO: 62690 - DNA, 70 bp, Artificial Sequence
  Synthetic
gccaagcatttaggtgacactatagtccttatcgtgtttttgtaggtttcagagctatgctggaaacagc

SEQ ID NO: 62691 - DNA, 70 bp, Artificial Sequence
  Synthetic
gccaagcatttaggtgacactatagccctactcctatgcgggatggtttcagagctatgctggaaacagc

SEQ ID NO: 62692 - DNA, 70 bp, Artificial Sequence
  Synthetic
gccaagcatttaggtgacactatagcagggtgggccagtttcagagtttcagagctatgctggaaacagc

SEQ ID NO: 62693 - DNA, 70 bp, Artificial Sequence
  Synthetic
gccaagcatttaggtgacactatagaaacttgctgcggttgctcagtttcagagctatgctggaaacagc

SEQ ID NO: 62694 - DNA, 70 bp, Artificial Sequence
  Synthetic
gccaagcatttaggtgacactataggaaaatgcttcccgttcttcgtttcagagctatgctggaaacagc

SEQ ID NO: 62695 - DNA, 70 bp, Artificial Sequence
  Synthetic
gccaagcatttaggtgacactataggaacagaaatcaggagatctgtttcagagctatgctggaaacagc

SEQ ID NO: 62696 - DNA, 70 bp, Artificial Sequence
  Synthetic
gccaagcatttaggtgacactataggaaaatccttcccgttcttcgtttcagagctatgctggaaacagc

SEQ ID NO: 62697 - DNA, 70 bp, Artificial Sequence
  Synthetic
gccaagcatttaggtgacactatagtccagggtggcaggctcactgtttcagagctatgctggaaacagc

SEQ ID NO: 62698 - DNA, 70 bp, Artificial Sequence
  Synthetic
gccaagcatttaggtgacactatagggctaatagcctaaagtgacgtttcagagctatgctggaaacagc

SEQ ID NO: 62699 - DNA, 70 bp, Artificial Sequence
  Synthetic
gccaagcatttaggtgacactatagttagctgcagtttgagcatcgtttcagagctatgctggaaacagc

SEQ ID NO: 62700 - DNA, 70 bp, Artificial Sequence
  Synthetic
gccaagcatttaggtgacactataggtggagatggggtggcctaggtttcagagctatgctggaaacagc

SEQ ID NO: 62701 - DNA, 70 bp, Artificial Sequence
  Synthetic
gccaagcatttaggtgacactatagaaggtggagggatcagaaccgtttcagagctatgctggaaacagc

SEQ ID NO: 62702 - DNA, 70 bp, Artificial Sequence
  Synthetic
gccaagcatttaggtgacactatagggccagggcagctcagacgagtttcagagctatgctggaaacagc

SEQ ID NO: 62703 - DNA, 70 bp, Artificial Sequence
  Synthetic
gccaagcatttaggtgacactatagttgtagtcagaaactgttgtgtttcagagctatgctggaaacagc

SEQ ID NO: 62704 - DNA, 70 bp, Artificial Sequence
  Synthetic
gccaagcatttaggtgacactataggactgttgggtagctgtcaggtttcagagctatgctggaaacagc

SEQ ID NO: 62705 - DNA, 70 bp, Artificial Sequence
  Synthetic
gccaagcatttaggtgacactatagcgtggagactcaggtgtgtggtttcagagctatgctggaaacagc

SEQ ID NO: 62706 - DNA, 70 bp, Artificial Sequence
  Synthetic
gccaagcatttaggtgacactatagtcatttgttgaaagtactgcgtttcagagctatgctggaaacagc

SEQ ID NO: 62707 - DNA, 70 bp, Artificial Sequence
  Synthetic
gccaagcatttaggtgacactatagtacaatcagatgttgccattgtttcagagctatgctggaaacagc

SEQ ID NO: 62708 - DNA, 70 bp, Artificial Sequence
  Synthetic
gccaagcatttaggtgacactatagacagtcctcctccgaggcctgtttcagagctatgctggaaacagc

SEQ ID NO: 62709 - DNA, 70 bp, Artificial Sequence
  Synthetic
gccaagcatttaggtgacactatagtcatgtagcatgaggctctggtttcagagctatgctggaaacagc

SEQ ID NO: 62710 - DNA, 70 bp, Artificial Sequence
  Synthetic
gccaagcatttaggtgacactatagggacttgcttcagtccttatgtttcagagctatgctggaaacagc

SEQ ID NO: 62711 - DNA, 70 bp, Artificial Sequence
  Synthetic
gccaagcatttaggtgacactatagaaatggctcccttttttgtggtttcagagctatgctggaaacagc

SEQ ID NO: 62712 - DNA, 70 bp, Artificial Sequence
  Synthetic
gccaagcatttaggtgacactatagaagaattctctcctgttctagtttcagagctatgctggaaacagc

SEQ ID NO: 62713 - DNA, 70 bp, Artificial Sequence
  Synthetic
gccaagcatttaggtgacactatagagatgagtcccccgctttaggtttcagagctatgctggaaacagc

SEQ ID NO: 62714 - DNA, 70 bp, Artificial Sequence
  Synthetic
gccaagcatttaggtgacactatagtcaccaggacagactctgatgtttcagagctatgctggaaacagc

SEQ ID NO: 62715 - DNA, 70 bp, Artificial Sequence
  Synthetic
gccaagcatttaggtgacactatagggtgagaattaggcacactggtttcagagctatgctggaaacagc

SEQ ID NO: 62716 - DNA, 70 bp, Artificial Sequence
  Synthetic
gccaagcatttaggtgacactatagtacaataacctgctttgatggtttcagagctatgctggaaacagc

SEQ ID NO: 62717 - DNA, 70 bp, Artificial Sequence
  Synthetic
gccaagcatttaggtgacactatagcacaagccatttcaataggagtttcagagctatgctggaaacagc

SEQ ID NO: 62718 - DNA, 70 bp, Artificial Sequence
  Synthetic
gccaagcatttaggtgacactatagtgtgcgctctgagttttatcgtttcagagctatgctggaaacagc

SEQ ID NO: 62719 - DNA, 70 bp, Artificial Sequence
  Synthetic
gccaagcatttaggtgacactatagccaacactccactcgctaaggtttcagagctatgctggaaacagc

SEQ ID NO: 62720 - DNA, 70 bp, Artificial Sequence
  Synthetic
gccaagcatttaggtgacactatagctgcggtaggaacggtcagggtttcagagctatgctggaaacagc

SEQ ID NO: 62721 - DNA, 70 bp, Artificial Sequence
  Synthetic
gccaagcatttaggtgacactatagccttgctcagtcttactaaagtttcagagctatgctggaaacagc

SEQ ID NO: 62722 - DNA, 70 bp, Artificial Sequence
  Synthetic
gccaagcatttaggtgacactatagttttcataacaggttagtgcgtttcagagctatgctggaaacagc

SEQ ID NO: 62723 - DNA, 70 bp, Artificial Sequence
  Synthetic
gccaagcatttaggtgacactatagttgtctcatctcaagctagggtttcagagctatgctggaaacagc

SEQ ID NO: 62724 - DNA, 70 bp, Artificial Sequence
  Synthetic
gccaagcatttaggtgacactatagtttccctgagtttgcttaaagtttcagagctatgctggaaacagc

SEQ ID NO: 62725 - DNA, 70 bp, Artificial Sequence
  Synthetic
gccaagcatttaggtgacactatagaggtctaactgagcctcctcgtttcagagctatgctggaaacagc

SEQ ID NO: 62726 - DNA, 70 bp, Artificial Sequence
  Synthetic
gccaagcatttaggtgacactatagatttaggaggcagctcttttgtttcagagctatgctggaaacagc

SEQ ID NO: 62727 - DNA, 70 bp, Artificial Sequence
  Synthetic
gccaagcatttaggtgacactatagcagcctgcctctttccttacgtttcagagctatgctggaaacagc

SEQ ID NO: 62728 - DNA, 70 bp, Artificial Sequence
  Synthetic
gccaagcatttaggtgacactataggcgtggcgaagctgagctgagtttcagagctatgctggaaacagc

SEQ ID NO: 62729 - DNA, 70 bp, Artificial Sequence
  Synthetic
gccaagcatttaggtgacactatagatgcagctgcatcccgtccagtttcagagctatgctggaaacagc

SEQ ID NO: 62730 - DNA, 70 bp, Artificial Sequence
  Synthetic
gccaagcatttaggtgacactatagttgtcaagttatctcgtcttgtttcagagctatgctggaaacagc

SEQ ID NO: 62731 - DNA, 70 bp, Artificial Sequence
  Synthetic
gccaagcatttaggtgacactatagagattcgatagccagtgagggtttcagagctatgctggaaacagc

SEQ ID NO: 62732 - DNA, 70 bp, Artificial Sequence
  Synthetic
gccaagcatttaggtgacactatagctagaaattctctcagggcagtttcagagctatgctggaaacagc

SEQ ID NO: 62733 - DNA, 70 bp, Artificial Sequence
  Synthetic
gccaagcatttaggtgacactatagactctctgcctgggctaggggtttcagagctatgctggaaacagc

SEQ ID NO: 62734 - DNA, 70 bp, Artificial Sequence
  Synthetic
gccaagcatttaggtgacactataggacgctcagctccactgagcgtttcagagctatgctggaaacagc

SEQ ID NO: 62735 - DNA, 70 bp, Artificial Sequence
  Synthetic
gccaagcatttaggtgacactatagccagcggtcagtgcagcaccgtttcagagctatgctggaaacagc

SEQ ID NO: 62736 - DNA, 70 bp, Artificial Sequence
  Synthetic
gccaagcatttaggtgacactatagcatccccccaccgccctgacgtttcagagctatgctggaaacagc

SEQ ID NO: 62737 - DNA, 70 bp, Artificial Sequence
  Synthetic
gccaagcatttaggtgacactatagataggggcaggtcagtttgcgtttcagagctatgctggaaacagc

SEQ ID NO: 62738 - DNA, 70 bp, Artificial Sequence
  Synthetic
gccaagcatttaggtgacactatagcttgggcctccagccctcaggtttcagagctatgctggaaacagc

SEQ ID NO: 62739 - DNA, 70 bp, Artificial Sequence
  Synthetic
gccaagcatttaggtgacactatagggtggaggaggcagacactcgtttcagagctatgctggaaacagc

SEQ ID NO: 62740 - DNA, 70 bp, Artificial Sequence
  Synthetic
gccaagcatttaggtgacactatagaatatggaaagcacctcatggtttcagagctatgctggaaacagc

SEQ ID NO: 62741 - DNA, 70 bp, Artificial Sequence
  Synthetic
gccaagcatttaggtgacactatagtaaaatccaacagccaaatggtttcagagctatgctggaaacagc

SEQ ID NO: 62742 - DNA, 70 bp, Artificial Sequence
  Synthetic
gccaagcatttaggtgacactatagctcggtacccttggtaccctgtttcagagctatgctggaaacagc

SEQ ID NO: 62743 - DNA, 70 bp, Artificial Sequence
  Synthetic
gccaagcatttaggtgacactatagagacgtgagagctatcacgagtttcagagctatgctggaaacagc

SEQ ID NO: 62744 - DNA, 70 bp, Artificial Sequence
  Synthetic
gccaagcatttaggtgacactatagcctttctctgccactctttggtttcagagctatgctggaaacagc

SEQ ID NO: 62745 - DNA, 70 bp, Artificial Sequence
  Synthetic
gccaagcatttaggtgacactatagcgtttctcacgtacaaatgcgtttcagagctatgctggaaacagc

SEQ ID NO: 62746 - DNA, 70 bp, Artificial Sequence
  Synthetic
gccaagcatttaggtgacactatagacaaggcaagtcttcatgctgtttcagagctatgctggaaacagc

SEQ ID NO: 62747 - DNA, 70 bp, Artificial Sequence
  Synthetic
gccaagcatttaggtgacactatagacccaagggctcacatgagagtttcagagctatgctggaaacagc

SEQ ID NO: 62748 - DNA, 70 bp, Artificial Sequence
  Synthetic
gccaagcatttaggtgacactatagatggcagtcagcttttcacagtttcagagctatgctggaaacagc

SEQ ID NO: 62749 - DNA, 70 bp, Artificial Sequence
  Synthetic
gccaagcatttaggtgacactataggtcctaggcaggtcttaggcgtttcagagctatgctggaaacagc

SEQ ID NO: 62750 - DNA, 70 bp, Artificial Sequence
  Synthetic
gccaagcatttaggtgacactatagcagcaaggtttcacaagacagtttcagagctatgctggaaacagc

SEQ ID NO: 62751 - DNA, 70 bp, Artificial Sequence
  Synthetic
gccaagcatttaggtgacactatagctgccttcttcaggtttcacgtttcagagctatgctggaaacagc

SEQ ID NO: 62752 - DNA, 70 bp, Artificial Sequence
  Synthetic
gccaagcatttaggtgacactataggaatgatgagcacacaaggcgtttcagagctatgctggaaacagc

SEQ ID NO: 62753 - DNA, 70 bp, Artificial Sequence
  Synthetic
gccaagcatttaggtgacactatagactgctgcaaggtgctatgagtttcagagctatgctggaaacagc

SEQ ID NO: 62754 - DNA, 70 bp, Artificial Sequence
  Synthetic
gccaagcatttaggtgacactatagtctccagcagtggcctgaaggtttcagagctatgctggaaacagc

SEQ ID NO: 62755 - DNA, 70 bp, Artificial Sequence
  Synthetic
gccaagcatttaggtgacactatagcccatcttcctcctcggctggtttcagagctatgctggaaacagc

SEQ ID NO: 62756 - DNA, 70 bp, Artificial Sequence
  Synthetic
gccaagcatttaggtgacactatagcgttgcttagtaatgtaaccgtttcagagctatgctggaaacagc

SEQ ID NO: 62757 - DNA, 70 bp, Artificial Sequence
  Synthetic
gccaagcatttaggtgacactataggccttggggatctcagagaagtttcagagctatgctggaaacagc

SEQ ID NO: 62758 - DNA, 70 bp, Artificial Sequence
  Synthetic
gccaagcatttaggtgacactatagcttttgcgtggtgacctgaggtttcagagctatgctggaaacagc

SEQ ID NO: 62759 - DNA, 70 bp, Artificial Sequence
  Synthetic
gccaagcatttaggtgacactatagctgccctgggtcagagcagcgtttcagagctatgctggaaacagc

SEQ ID NO: 62760 - DNA, 70 bp, Artificial Sequence
  Synthetic
gccaagcatttaggtgacactatagccaagtgccagggtcacaaggtttcagagctatgctggaaacagc

SEQ ID NO: 62761 - DNA, 70 bp, Artificial Sequence
  Synthetic
gccaagcatttaggtgacactataggaagatcttgcactcattgagtttcagagctatgctggaaacagc

SEQ ID NO: 62762 - DNA, 70 bp, Artificial Sequence
  Synthetic
gccaagcatttaggtgacactatagagctgctgttcaattatctggtttcagagctatgctggaaacagc

SEQ ID NO: 62763 - DNA, 70 bp, Artificial Sequence
  Synthetic
gccaagcatttaggtgacactatagaaacagtcttcaatcccttcgtttcagagctatgctggaaacagc

SEQ ID NO: 62764 - DNA, 70 bp, Artificial Sequence
  Synthetic
gccaagcatttaggtgacactatagtgctactgtttttgcagtttgtttcagagctatgctggaaacagc

SEQ ID NO: 62765 - DNA, 70 bp, Artificial Sequence
  Synthetic
gccaagcatttaggtgacactatagttgggtaccaggggcctcacgtttcagagctatgctggaaacagc

SEQ ID NO: 62766 - DNA, 70 bp, Artificial Sequence
  Synthetic
gccaagcatttaggtgacactatagacagcagtacttcttccaccgtttcagagctatgctggaaacagc

SEQ ID NO: 62767 - DNA, 70 bp, Artificial Sequence
  Synthetic
gccaagcatttaggtgacactatagagcagaagaacttcttccaggtttcagagctatgctggaaacagc

SEQ ID NO: 62768 - DNA, 70 bp, Artificial Sequence
  Synthetic
gccaagcatttaggtgacactatagcgactgtgtctacatcgtcggtttcagagctatgctggaaacagc

SEQ ID NO: 62769 - DNA, 70 bp, Artificial Sequence
  Synthetic
gccaagcatttaggtgacactatagtcacattccccaatgtctaagtttcagagctatgctggaaacagc

SEQ ID NO: 62770 - DNA, 70 bp, Artificial Sequence
  Synthetic
gccaagcatttaggtgacactatagagcacccagggtggccgtgagtttcagagctatgctggaaacagc

SEQ ID NO: 62771 - DNA, 70 bp, Artificial Sequence
  Synthetic
gccaagcatttaggtgacactatagttctcaactcagacagttctgtttcagagctatgctggaaacagc

SEQ ID NO: 62772 - DNA, 70 bp, Artificial Sequence
  Synthetic
gccaagcatttaggtgacactatagcctccagactcagagacctggtttcagagctatgctggaaacagc

SEQ ID NO: 62773 - DNA, 70 bp, Artificial Sequence
  Synthetic
gccaagcatttaggtgacactatagcactaccacctagaactcacgtttcagagctatgctggaaacagc

SEQ ID NO: 62774 - DNA, 70 bp, Artificial Sequence
  Synthetic
gccaagcatttaggtgacactataggatagacatcctgaacttaggtttcagagctatgctggaaacagc

SEQ ID NO: 62775 - DNA, 70 bp, Artificial Sequence
  Synthetic
gccaagcatttaggtgacactatagaatacaggaagtcgataatggtttcagagctatgctggaaacagc

SEQ ID NO: 62776 - DNA, 70 bp, Artificial Sequence
  Synthetic
gccaagcatttaggtgacactatagaggaagaaccttttcaggatgtttcagagctatgctggaaacagc

SEQ ID NO: 62777 - DNA, 70 bp, Artificial Sequence
  Synthetic
gccaagcatttaggtgacactataggacttcatgtcacttgtacagtttcagagctatgctggaaacagc

SEQ ID NO: 62778 - DNA, 70 bp, Artificial Sequence
  Synthetic
gccaagcatttaggtgacactataggagtgggacctaatggtgaggtttcagagctatgctggaaacagc

SEQ ID NO: 62779 - DNA, 70 bp, Artificial Sequence
  Synthetic
gccaagcatttaggtgacactataggctgttttcactctaaacccgtttcagagctatgctggaaacagc

SEQ ID NO: 62780 - DNA, 70 bp, Artificial Sequence
  Synthetic
gccaagcatttaggtgacactatagaagagctgccatcctcagtcgtttcagagctatgctggaaacagc

SEQ ID NO: 62781 - DNA, 70 bp, Artificial Sequence
  Synthetic
gccaagcatttaggtgacactatagaaggacctgcaccaggatgggtttcagagctatgctggaaacagc

SEQ ID NO: 62782 - DNA, 70 bp, Artificial Sequence
  Synthetic
gccaagcatttaggtgacactatagcttttagtctgtgtcagagcgtttcagagctatgctggaaacagc

SEQ ID NO: 62783 - DNA, 70 bp, Artificial Sequence
  Synthetic
gccaagcatttaggtgacactatagtcagcagatgtatcaactatgtttcagagctatgctggaaacagc

SEQ ID NO: 62784 - DNA, 70 bp, Artificial Sequence
  Synthetic
gccaagcatttaggtgacactatagacaacggcatcactataagtgtttcagagctatgctggaaacagc

SEQ ID NO: 62785 - DNA, 70 bp, Artificial Sequence
  Synthetic
gccaagcatttaggtgacactataggcacgagaaactaagttgtagtttcagagctatgctggaaacagc

SEQ ID NO: 62786 - DNA, 70 bp, Artificial Sequence
  Synthetic
gccaagcatttaggtgacactatagtagctgcatgtgaatcttgtgtttcagagctatgctggaaacagc

SEQ ID NO: 62787 - DNA, 70 bp, Artificial Sequence
  Synthetic
gccaagcatttaggtgacactatagagacccctaagtcaggcctcgtttcagagctatgctggaaacagc

SEQ ID NO: 62788 - DNA, 70 bp, Artificial Sequence
  Synthetic
gccaagcatttaggtgacactatagagggaaacaagtcgtcggacgtttcagagctatgctggaaacagc

SEQ ID NO: 62789 - DNA, 70 bp, Artificial Sequence
  Synthetic
gccaagcatttaggtgacactataggccaaggtcacagatgctgcgtttcagagctatgctggaaacagc

SEQ ID NO: 62790 - DNA, 70 bp, Artificial Sequence
  Synthetic
gccaagcatttaggtgacactatagaaatgctggcaggaacaagggtttcagagctatgctggaaacagc

SEQ ID NO: 62791 - DNA, 70 bp, Artificial Sequence
  Synthetic
gccaagcatttaggtgacactatagaagaaactgctgaaaaagctgtttcagagctatgctggaaacagc

SEQ ID NO: 62792 - DNA, 70 bp, Artificial Sequence
  Synthetic
gccaagcatttaggtgacactatagaatgcgctcaaaggcaaaaagtttcagagctatgctggaaacagc

SEQ ID NO: 62793 - DNA, 70 bp, Artificial Sequence
  Synthetic
gccaagcatttaggtgacactatagaggctctgaacttggcaagcgtttcagagctatgctggaaacagc

SEQ ID NO: 62794 - DNA, 70 bp, Artificial Sequence
  Synthetic
gccaagcatttaggtgacactatagcaatgcgctcaaaggcaaaagtttcagagctatgctggaaacagc

SEQ ID NO: 62795 - DNA, 70 bp, Artificial Sequence
  Synthetic
gccaagcatttaggtgacactatagttcctgaaaggctctgaactgtttcagagctatgctggaaacagc

SEQ ID NO: 62796 - DNA, 70 bp, Artificial Sequence
  Synthetic
gccaagcatttaggtgacactatagggatgcttgctcagtgtccagtttcagagctatgctggaaacagc

SEQ ID NO: 62797 - DNA, 70 bp, Artificial Sequence
  Synthetic
gccaagcatttaggtgacactatagctggctacaacattaacaacgtttcagagctatgctggaaacagc

SEQ ID NO: 62798 - DNA, 70 bp, Artificial Sequence
  Synthetic
gccaagcatttaggtgacactatagagccaatgaaatcaaactacgtttcagagctatgctggaaacagc

SEQ ID NO: 62799 - DNA, 70 bp, Artificial Sequence
  Synthetic
gccaagcatttaggtgacactatagagttcactatgatcgaatacgtttcagagctatgctggaaacagc

SEQ ID NO: 62800 - DNA, 70 bp, Artificial Sequence
  Synthetic
gccaagcatttaggtgacactatagccacaagtgccagtgagaaggtttcagagctatgctggaaacagc

SEQ ID NO: 62801 - DNA, 70 bp, Artificial Sequence
  Synthetic
gccaagcatttaggtgacactataggcggaggccgcgtgtctctagtttcagagctatgctggaaacagc

SEQ ID NO: 62802 - DNA, 70 bp, Artificial Sequence
  Synthetic
gccaagcatttaggtgacactatagtgctatgaacgagagtaagagtttcagagctatgctggaaacagc

SEQ ID NO: 62803 - DNA, 70 bp, Artificial Sequence
  Synthetic
gccaagcatttaggtgacactatagaccagcccctcatgctcttagtttcagagctatgctggaaacagc

SEQ ID NO: 62804 - DNA, 70 bp, Artificial Sequence
  Synthetic
gccaagcatttaggtgacactataggcactaagatcgttctccgcgtttcagagctatgctggaaacagc

SEQ ID NO: 62805 - DNA, 70 bp, Artificial Sequence
  Synthetic
gccaagcatttaggtgacactatagagagggaagccgggcagcaggtttcagagctatgctggaaacagc

SEQ ID NO: 62806 - DNA, 70 bp, Artificial Sequence
  Synthetic
gccaagcatttaggtgacactatagagtcccgcctgtcttctagggtttcagagctatgctggaaacagc

SEQ ID NO: 62807 - DNA, 70 bp, Artificial Sequence
  Synthetic
gccaagcatttaggtgacactataggcgccccgggagggcctcacgtttcagagctatgctggaaacagc

SEQ ID NO: 62808 - DNA, 70 bp, Artificial Sequence
  Synthetic
gccaagcatttaggtgacactataggtcccctggtggggtcacttgtttcagagctatgctggaaacagc

SEQ ID NO: 62809 - DNA, 70 bp, Artificial Sequence
  Synthetic
gccaagcatttaggtgacactatagcagggaccagtgacaactaggtttcagagctatgctggaaacagc

SEQ ID NO: 62810 - DNA, 70 bp, Artificial Sequence
  Synthetic
gccaagcatttaggtgacactatagaggacaaattggcctaatacgtttcagagctatgctggaaacagc

SEQ ID NO: 62811 - DNA, 70 bp, Artificial Sequence
  Synthetic
gccaagcatttaggtgacactatagaagacagccaagacgaaaaagtttcagagctatgctggaaacagc

SEQ ID NO: 62812 - DNA, 70 bp, Artificial Sequence
  Synthetic
gccaagcatttaggtgacactataggacagaagtctatacctgaagtttcagagctatgctggaaacagc

SEQ ID NO: 62813 - DNA, 70 bp, Artificial Sequence
  Synthetic
gccaagcatttaggtgacactatagttggaagcagccagcttttggtttcagagctatgctggaaacagc

SEQ ID NO: 62814 - DNA, 70 bp, Artificial Sequence
  Synthetic
gccaagcatttaggtgacactatagatcacgttcagaagaatggagtttcagagctatgctggaaacagc

SEQ ID NO: 62815 - DNA, 70 bp, Artificial Sequence
  Synthetic
gccaagcatttaggtgacactatagagaaactaatttagggctaggtttcagagctatgctggaaacagc

SEQ ID NO: 62816 - DNA, 70 bp, Artificial Sequence
  Synthetic
gccaagcatttaggtgacactatagaaagcctggtattatccctcgtttcagagctatgctggaaacagc

SEQ ID NO: 62817 - DNA, 70 bp, Artificial Sequence
  Synthetic
gccaagcatttaggtgacactatagagcccatccagggttagttcgtttcagagctatgctggaaacagc

SEQ ID NO: 62818 - DNA, 70 bp, Artificial Sequence
  Synthetic
gccaagcatttaggtgacactataggccttacccggaaatacttggtttcagagctatgctggaaacagc

SEQ ID NO: 62819 - DNA, 70 bp, Artificial Sequence
  Synthetic
gccaagcatttaggtgacactatagagggttggtataatcatagcgtttcagagctatgctggaaacagc

SEQ ID NO: 62820 - DNA, 70 bp, Artificial Sequence
  Synthetic
gccaagcatttaggtgacactataggcggcgaagcaagacctagcgtttcagagctatgctggaaacagc

SEQ ID NO: 62821 - DNA, 70 bp, Artificial Sequence
  Synthetic
gccaagcatttaggtgacactatagaatagtttagaatgctgtgcgtttcagagctatgctggaaacagc

SEQ ID NO: 62822 - DNA, 70 bp, Artificial Sequence
  Synthetic
gccaagcatttaggtgacactatagaacctgtaattaaaaggctggtttcagagctatgctggaaacagc

SEQ ID NO: 62823 - DNA, 70 bp, Artificial Sequence
  Synthetic
gccaagcatttaggtgacactatagagagcagtataaagagtttcgtttcagagctatgctggaaacagc

SEQ ID NO: 62824 - DNA, 70 bp, Artificial Sequence
  Synthetic
gccaagcatttaggtgacactatagtcttggacggagatcactgagtttcagagctatgctggaaacagc

SEQ ID NO: 62825 - DNA, 70 bp, Artificial Sequence
  Synthetic
gccaagcatttaggtgacactatagtgatttcaacatctgcctccgtttcagagctatgctggaaacagc

SEQ ID NO: 62826 - DNA, 70 bp, Artificial Sequence
  Synthetic
gccaagcatttaggtgacactatagggatgaagaagagaagtagggtttcagagctatgctggaaacagc

SEQ ID NO: 62827 - DNA, 70 bp, Artificial Sequence
  Synthetic
gccaagcatttaggtgacactatagtgatagcgaagatgaaattggtttcagagctatgctggaaacagc

SEQ ID NO: 62828 - DNA, 70 bp, Artificial Sequence
  Synthetic
gccaagcatttaggtgacactatagctagcctctgcacactcagcgtttcagagctatgctggaaacagc

SEQ ID NO: 62829 - DNA, 70 bp, Artificial Sequence
  Synthetic
gccaagcatttaggtgacactataggagacagagactgattcattgtttcagagctatgctggaaacagc

SEQ ID NO: 62830 - DNA, 70 bp, Artificial Sequence
  Synthetic
gccaagcatttaggtgacactataggaatctttcttcttccggaagtttcagagctatgctggaaacagc

SEQ ID NO: 62831 - DNA, 70 bp, Artificial Sequence
  Synthetic
gccaagcatttaggtgacactatagagcctgtggaagaagctcaagtttcagagctatgctggaaacagc

SEQ ID NO: 62832 - DNA, 70 bp, Artificial Sequence
  Synthetic
gccaagcatttaggtgacactatagttggaagggaagaattctgagtttcagagctatgctggaaacagc

SEQ ID NO: 62833 - DNA, 70 bp, Artificial Sequence
  Synthetic
gccaagcatttaggtgacactatagaaagagtatcatttccaagggtttcagagctatgctggaaacagc

SEQ ID NO: 62834 - DNA, 70 bp, Artificial Sequence
  Synthetic
gccaagcatttaggtgacactatagtggcaggagatgttttcagagtttcagagctatgctggaaacagc

SEQ ID NO: 62835 - DNA, 70 bp, Artificial Sequence
  Synthetic
gccaagcatttaggtgacactatagaagacagatgagctttgtgtgtttcagagctatgctggaaacagc

SEQ ID NO: 62836 - DNA, 70 bp, Artificial Sequence
  Synthetic
gccaagcatttaggtgacactatagcgcagagcagtcttagcttcgtttcagagctatgctggaaacagc

SEQ ID NO: 62837 - DNA, 70 bp, Artificial Sequence
  Synthetic
gccaagcatttaggtgacactataggcctaattggttgtaccaaagtttcagagctatgctggaaacagc

SEQ ID NO: 62838 - DNA, 70 bp, Artificial Sequence
  Synthetic
gccaagcatttaggtgacactatagtgcttcacccgagagttcctgtttcagagctatgctggaaacagc

SEQ ID NO: 62839 - DNA, 70 bp, Artificial Sequence
  Synthetic
gccaagcatttaggtgacactatagatcttttggtacaaccaacagtttcagagctatgctggaaacagc

SEQ ID NO: 62840 - DNA, 70 bp, Artificial Sequence
  Synthetic
gccaagcatttaggtgacactatagcccagccctcaaactagcaagtttcagagctatgctggaaacagc

SEQ ID NO: 62841 - DNA, 70 bp, Artificial Sequence
  Synthetic
gccaagcatttaggtgacactatagtcttcatcagcatctgcatcgtttcagagctatgctggaaacagc

SEQ ID NO: 62842 - DNA, 70 bp, Artificial Sequence
  Synthetic
gccaagcatttaggtgacactatagctatccagcacacacagagggtttcagagctatgctggaaacagc

SEQ ID NO: 62843 - DNA, 70 bp, Artificial Sequence
  Synthetic
gccaagcatttaggtgacactataggagaaacagaagcagctgaagtttcagagctatgctggaaacagc

SEQ ID NO: 62844 - DNA, 70 bp, Artificial Sequence
  Synthetic
gccaagcatttaggtgacactataggcttcctactgttaccaaaggtttcagagctatgctggaaacagc

SEQ ID NO: 62845 - DNA, 70 bp, Artificial Sequence
  Synthetic
gccaagcatttaggtgacactatagccagaaggacctggaagaacgtttcagagctatgctggaaacagc

SEQ ID NO: 62846 - DNA, 70 bp, Artificial Sequence
  Synthetic
gccaagcatttaggtgacactatagaccttgagaatctaaagaaggtttcagagctatgctggaaacagc

SEQ ID NO: 62847 - DNA, 70 bp, Artificial Sequence
  Synthetic
gccaagcatttaggtgacactatagtggaggtagaagatttacacgtttcagagctatgctggaaacagc

SEQ ID NO: 62848 - DNA, 70 bp, Artificial Sequence
  Synthetic
gccaagcatttaggtgacactatagtgtcatcctcattaccataggtttcagagctatgctggaaacagc

SEQ ID NO: 62849 - DNA, 70 bp, Artificial Sequence
  Synthetic
gccaagcatttaggtgacactatagaatatctgtttggcatctccgtttcagagctatgctggaaacagc

SEQ ID NO: 62850 - DNA, 70 bp, Artificial Sequence
  Synthetic
gccaagcatttaggtgacactatagtggagcagaacccggcagatgtttcagagctatgctggaaacagc

SEQ ID NO: 62851 - DNA, 70 bp, Artificial Sequence
  Synthetic
gccaagcatttaggtgacactatagtctgtggaggactctacctagtttcagagctatgctggaaacagc

SEQ ID NO: 62852 - DNA, 70 bp, Artificial Sequence
  Synthetic
gccaagcatttaggtgacactatagatgaagcgccagttaccaacgtttcagagctatgctggaaacagc

SEQ ID NO: 62853 - DNA, 70 bp, Artificial Sequence
  Synthetic
gccaagcatttaggtgacactatagctgatgagctggttagtttggtttcagagctatgctggaaacagc

SEQ ID NO: 62854 - DNA, 70 bp, Artificial Sequence
  Synthetic
gccaagcatttaggtgacactatagttgaggccagatagtttcctgtttcagagctatgctggaaacagc

SEQ ID NO: 62855 - DNA, 70 bp, Artificial Sequence
  Synthetic
gccaagcatttaggtgacactatagggtatcgctggtctctattcgtttcagagctatgctggaaacagc

SEQ ID NO: 62856 - DNA, 70 bp, Artificial Sequence
  Synthetic
gccaagcatttaggtgacactataggagcttagatgattctatccgtttcagagctatgctggaaacagc

SEQ ID NO: 62857 - DNA, 70 bp, Artificial Sequence
  Synthetic
gccaagcatttaggtgacactatagtgctgatacaggagcttagagtttcagagctatgctggaaacagc

SEQ ID NO: 62858 - DNA, 70 bp, Artificial Sequence
  Synthetic
gccaagcatttaggtgacactatagcagagccatcagtatcttaggtttcagagctatgctggaaacagc

SEQ ID NO: 62859 - DNA, 70 bp, Artificial Sequence
  Synthetic
gccaagcatttaggtgacactatagcaggtgcctgtgcactttgagtttcagagctatgctggaaacagc

SEQ ID NO: 62860 - DNA, 70 bp, Artificial Sequence
  Synthetic
gccaagcatttaggtgacactataggagcgatcccccctacaagtgtttcagagctatgctggaaacagc

SEQ ID NO: 62861 - DNA, 70 bp, Artificial Sequence
  Synthetic
gccaagcatttaggtgacactatagaagccagtctggaaacctaagtttcagagctatgctggaaacagc

SEQ ID NO: 62862 - DNA, 70 bp, Artificial Sequence
  Synthetic
gccaagcatttaggtgacactatagcccacttgttcctgtgcactgtttcagagctatgctggaaacagc

SEQ ID NO: 62863 - DNA, 70 bp, Artificial Sequence
  Synthetic
gccaagcatttaggtgacactatagagaagtttcctcagtgaggagtttcagagctatgctggaaacagc

SEQ ID NO: 62864 - DNA, 70 bp, Artificial Sequence
  Synthetic
gccaagcatttaggtgacactatagcagagaaggagctaaacaatgtttcagagctatgctggaaacagc

SEQ ID NO: 62865 - DNA, 70 bp, Artificial Sequence
  Synthetic
gccaagcatttaggtgacactatagcgcgtagaggcagctgctaggtttcagagctatgctggaaacagc

SEQ ID NO: 62866 - DNA, 70 bp, Artificial Sequence
  Synthetic
gccaagcatttaggtgacactataggacagaaaaggggcaagtgagtttcagagctatgctggaaacagc

SEQ ID NO: 62867 - DNA, 70 bp, Artificial Sequence
  Synthetic
gccaagcatttaggtgacactatagttggctaaagttgacaagaggtttcagagctatgctggaaacagc

SEQ ID NO: 62868 - DNA, 70 bp, Artificial Sequence
  Synthetic
gccaagcatttaggtgacactatagaagctctggttctcagtcctgtttcagagctatgctggaaacagc

SEQ ID NO: 62869 - DNA, 70 bp, Artificial Sequence
  Synthetic
gccaagcatttaggtgacactatagaaggaatacatggtgcgctagtttcagagctatgctggaaacagc

SEQ ID NO: 62870 - DNA, 70 bp, Artificial Sequence
  Synthetic
gccaagcatttaggtgacactatagtggccagccctgggtgctgagtttcagagctatgctggaaacagc

SEQ ID NO: 62871 - DNA, 70 bp, Artificial Sequence
  Synthetic
gccaagcatttaggtgacactatagaaaacttgggcatcaatgctgtttcagagctatgctggaaacagc

SEQ ID NO: 62872 - DNA, 70 bp, Artificial Sequence
  Synthetic
gccaagcatttaggtgacactatagagctgttccattatgtgaaggtttcagagctatgctggaaacagc

SEQ ID NO: 62873 - DNA, 70 bp, Artificial Sequence
  Synthetic
gccaagcatttaggtgacactatagaagctgcaacctcatgtgaggtttcagagctatgctggaaacagc

SEQ ID NO: 62874 - DNA, 70 bp, Artificial Sequence
  Synthetic
gccaagcatttaggtgacactatagagttgctacggacttacgaagtttcagagctatgctggaaacagc

SEQ ID NO: 62875 - DNA, 70 bp, Artificial Sequence
  Synthetic
gccaagcatttaggtgacactatagcctgggccagtagtgtcactgtttcagagctatgctggaaacagc

SEQ ID NO: 62876 - DNA, 70 bp, Artificial Sequence
  Synthetic
gccaagcatttaggtgacactatagagatgggacatcatttgacagtttcagagctatgctggaaacagc

SEQ ID NO: 62877 - DNA, 70 bp, Artificial Sequence
  Synthetic
gccaagcatttaggtgacactatagcacaaaagatggcatctggcgtttcagagctatgctggaaacagc

SEQ ID NO: 62878 - DNA, 70 bp, Artificial Sequence
  Synthetic
gccaagcatttaggtgacactatagcctggctcaattagtctcatgtttcagagctatgctggaaacagc

SEQ ID NO: 62879 - DNA, 70 bp, Artificial Sequence
  Synthetic
gccaagcatttaggtgacactatagacatggtgtcaactttcactgtttcagagctatgctggaaacagc

SEQ ID NO: 62880 - DNA, 70 bp, Artificial Sequence
  Synthetic
gccaagcatttaggtgacactatagcctggggctgttactcttccgtttcagagctatgctggaaacagc

SEQ ID NO: 62881 - DNA, 70 bp, Artificial Sequence
  Synthetic
gccaagcatttaggtgacactatagggatgcaattcccattacttgtttcagagctatgctggaaacagc

SEQ ID NO: 62882 - DNA, 70 bp, Artificial Sequence
  Synthetic
gccaagcatttaggtgacactatagcaaaagcttcaggctgcagagtttcagagctatgctggaaacagc

SEQ ID NO: 62883 - DNA, 70 bp, Artificial Sequence
  Synthetic
gccaagcatttaggtgacactatagcaagcacggactctgctcacgtttcagagctatgctggaaacagc

SEQ ID NO: 62884 - DNA, 70 bp, Artificial Sequence
  Synthetic
gccaagcatttaggtgacactatagtttagcttcagaaagtccatgtttcagagctatgctggaaacagc

SEQ ID NO: 62885 - DNA, 70 bp, Artificial Sequence
  Synthetic
gccaagcatttaggtgacactataggtgtccctactgcaaagagagtttcagagctatgctggaaacagc

SEQ ID NO: 62886 - DNA, 70 bp, Artificial Sequence
  Synthetic
gccaagcatttaggtgacactatagatgctcttcatcactattccgtttcagagctatgctggaaacagc

SEQ ID NO: 62887 - DNA, 70 bp, Artificial Sequence
  Synthetic
gccaagcatttaggtgacactatagtgggattctattggatgagcgtttcagagctatgctggaaacagc

SEQ ID NO: 62888 - DNA, 70 bp, Artificial Sequence
  Synthetic
gccaagcatttaggtgacactatagctgtgagggctaggcagctggtttcagagctatgctggaaacagc

SEQ ID NO: 62889 - DNA, 70 bp, Artificial Sequence
  Synthetic
gccaagcatttaggtgacactatagtcacatattcaagaagtgacgtttcagagctatgctggaaacagc

SEQ ID NO: 62890 - DNA, 70 bp, Artificial Sequence
  Synthetic
gccaagcatttaggtgacactataggtgggctcacgagttgcttggtttcagagctatgctggaaacagc

SEQ ID NO: 62891 - DNA, 70 bp, Artificial Sequence
  Synthetic
gccaagcatttaggtgacactatagcgaacagcagtctcttgattgtttcagagctatgctggaaacagc

SEQ ID NO: 62892 - DNA, 70 bp, Artificial Sequence
  Synthetic
gccaagcatttaggtgacactataggttgcagcctaatggtgaacgtttcagagctatgctggaaacagc

SEQ ID NO: 62893 - DNA, 70 bp, Artificial Sequence
  Synthetic
gccaagcatttaggtgacactatagatgttgatttctcctgttctgtttcagagctatgctggaaacagc

SEQ ID NO: 62894 - DNA, 70 bp, Artificial Sequence
  Synthetic
gccaagcatttaggtgacactatagattagcattcaagctagctggtttcagagctatgctggaaacagc

SEQ ID NO: 62895 - DNA, 70 bp, Artificial Sequence
  Synthetic
gccaagcatttaggtgacactatagatgttcatccttcaccttgagtttcagagctatgctggaaacagc

SEQ ID NO: 62896 - DNA, 70 bp, Artificial Sequence
  Synthetic
gccaagcatttaggtgacactatagggaaaggctcttcaagttaagtttcagagctatgctggaaacagc

SEQ ID NO: 62897 - DNA, 70 bp, Artificial Sequence
  Synthetic
gccaagcatttaggtgacactatagtggctgtatggcttacatccgtttcagagctatgctggaaacagc

SEQ ID NO: 62898 - DNA, 70 bp, Artificial Sequence
  Synthetic
gccaagcatttaggtgacactatagaagattcttcaacagcagttgtttcagagctatgctggaaacagc

SEQ ID NO: 62899 - DNA, 70 bp, Artificial Sequence
  Synthetic
gccaagcatttaggtgacactatagaatggagtgattcagcacacgtttcagagctatgctggaaacagc

SEQ ID NO: 62900 - DNA, 70 bp, Artificial Sequence
  Synthetic
gccaagcatttaggtgacactatagcgacgatatttgggaagatggtttcagagctatgctggaaacagc

SEQ ID NO: 62901 - DNA, 70 bp, Artificial Sequence
  Synthetic
gccaagcatttaggtgacactatagcacttcaaggtcatggcctggtttcagagctatgctggaaacagc

SEQ ID NO: 62902 - DNA, 70 bp, Artificial Sequence
  Synthetic
gccaagcatttaggtgacactatagaattgagtattggctctggagtttcagagctatgctggaaacagc

SEQ ID NO: 62903 - DNA, 70 bp, Artificial Sequence
  Synthetic
gccaagcatttaggtgacactatagagcatcgcgcttcctctagggtttcagagctatgctggaaacagc

SEQ ID NO: 62904 - DNA, 70 bp, Artificial Sequence
  Synthetic
gccaagcatttaggtgacactatagtgtgatctggcatcggacacgtttcagagctatgctggaaacagc

SEQ ID NO: 62905 - DNA, 70 bp, Artificial Sequence
  Synthetic
gccaagcatttaggtgacactatagacacagagatctttaggttggtttcagagctatgctggaaacagc

SEQ ID NO: 62906 - DNA, 70 bp, Artificial Sequence
  Synthetic
gccaagcatttaggtgacactatagatcctgttgaatcagcctaggtttcagagctatgctggaaacagc

SEQ ID NO: 62907 - DNA, 70 bp, Artificial Sequence
  Synthetic
gccaagcatttaggtgacactataggttactgtgcactgtccatcgtttcagagctatgctggaaacagc

SEQ ID NO: 62908 - DNA, 70 bp, Artificial Sequence
  Synthetic
gccaagcatttaggtgacactatagcaggatgtcacacttgcacagtttcagagctatgctggaaacagc

SEQ ID NO: 62909 - DNA, 70 bp, Artificial Sequence
  Synthetic
gccaagcatttaggtgacactatagtgggcacgtgtgctaggagagtttcagagctatgctggaaacagc

SEQ ID NO: 62910 - DNA, 70 bp, Artificial Sequence
  Synthetic
gccaagcatttaggtgacactatagatttcacttcttcacagtccgtttcagagctatgctggaaacagc

SEQ ID NO: 62911 - DNA, 70 bp, Artificial Sequence
  Synthetic
gccaagcatttaggtgacactatagggccaacataccttgtaaatgtttcagagctatgctggaaacagc

SEQ ID NO: 62912 - DNA, 70 bp, Artificial Sequence
  Synthetic
gccaagcatttaggtgacactatagacatagctgagtttggatcggtttcagagctatgctggaaacagc

SEQ ID NO: 62913 - DNA, 70 bp, Artificial Sequence
  Synthetic
gccaagcatttaggtgacactataggtgatatcctgtggctgaaggtttcagagctatgctggaaacagc

SEQ ID NO: 62914 - DNA, 70 bp, Artificial Sequence
  Synthetic
gccaagcatttaggtgacactataggctggggctcagacagccaagtttcagagctatgctggaaacagc

SEQ ID NO: 62915 - DNA, 70 bp, Artificial Sequence
  Synthetic
gccaagcatttaggtgacactatagaactgggagccgacagctgagtttcagagctatgctggaaacagc

SEQ ID NO: 62916 - DNA, 70 bp, Artificial Sequence
  Synthetic
gccaagcatttaggtgacactataggtctctctctgagaactgaagtttcagagctatgctggaaacagc

SEQ ID NO: 62917 - DNA, 70 bp, Artificial Sequence
  Synthetic
gccaagcatttaggtgacactataggtgtggggggttattagaccgtttcagagctatgctggaaacagc

SEQ ID NO: 62918 - DNA, 70 bp, Artificial Sequence
  Synthetic
gccaagcatttaggtgacactatagtttcagagatgcacaaagtagtttcagagctatgctggaaacagc

SEQ ID NO: 62919 - DNA, 70 bp, Artificial Sequence
  Synthetic
gccaagcatttaggtgacactatagacacttcattaggtgctactgtttcagagctatgctggaaacagc

SEQ ID NO: 62920 - DNA, 70 bp, Artificial Sequence
  Synthetic
gccaagcatttaggtgacactatagatatgccgttggtagaaatggtttcagagctatgctggaaacagc

SEQ ID NO: 62921 - DNA, 70 bp, Artificial Sequence
  Synthetic
gccaagcatttaggtgacactatagatcgagaagtgataacccaagtttcagagctatgctggaaacagc

SEQ ID NO: 62922 - DNA, 70 bp, Artificial Sequence
  Synthetic
gccaagcatttaggtgacactataggtttccatcctttggttctcgtttcagagctatgctggaaacagc

SEQ ID NO: 62923 - DNA, 70 bp, Artificial Sequence
  Synthetic
gccaagcatttaggtgacactatagctattcactagggctggaatgtttcagagctatgctggaaacagc

SEQ ID NO: 62924 - DNA, 70 bp, Artificial Sequence
  Synthetic
gccaagcatttaggtgacactatagattaggcagcttatccattcgtttcagagctatgctggaaacagc

SEQ ID NO: 62925 - DNA, 70 bp, Artificial Sequence
  Synthetic
gccaagcatttaggtgacactatagtattcagtgaactgggtcatgtttcagagctatgctggaaacagc

SEQ ID NO: 62926 - DNA, 70 bp, Artificial Sequence
  Synthetic
gccaagcatttaggtgacactatagtgaaagatggctacagaagcgtttcagagctatgctggaaacagc

SEQ ID NO: 62927 - DNA, 70 bp, Artificial Sequence
  Synthetic
gccaagcatttaggtgacactatagtgaaatgcttttctgcagctgtttcagagctatgctggaaacagc

SEQ ID NO: 62928 - DNA, 70 bp, Artificial Sequence
  Synthetic
gccaagcatttaggtgacactatagggagccatgtacacgtgagggtttcagagctatgctggaaacagc

SEQ ID NO: 62929 - DNA, 70 bp, Artificial Sequence
  Synthetic
gccaagcatttaggtgacactatagttgcatatcagttaagaagggtttcagagctatgctggaaacagc

SEQ ID NO: 62930 - DNA, 70 bp, Artificial Sequence
  Synthetic
gccaagcatttaggtgacactatagagcagttcctttggggtgtggtttcagagctatgctggaaacagc

SEQ ID NO: 62931 - DNA, 70 bp, Artificial Sequence
  Synthetic
gccaagcatttaggtgacactataggagcccagcattaggcaatcgtttcagagctatgctggaaacagc

SEQ ID NO: 62932 - DNA, 70 bp, Artificial Sequence
  Synthetic
gccaagcatttaggtgacactatagatcagagggcactcaggcaagtttcagagctatgctggaaacagc

SEQ ID NO: 62933 - DNA, 70 bp, Artificial Sequence
  Synthetic
gccaagcatttaggtgacactatagggatgacagcagactgcagcgtttcagagctatgctggaaacagc

SEQ ID NO: 62934 - DNA, 70 bp, Artificial Sequence
  Synthetic
gccaagcatttaggtgacactatagcaaccactcacatcagacaagtttcagagctatgctggaaacagc

SEQ ID NO: 62935 - DNA, 70 bp, Artificial Sequence
  Synthetic
gccaagcatttaggtgacactatagggagaagccagagtatgaaggtttcagagctatgctggaaacagc

SEQ ID NO: 62936 - DNA, 70 bp, Artificial Sequence
  Synthetic
gccaagcatttaggtgacactatagccactttgctgagtcatgcagtttcagagctatgctggaaacagc

SEQ ID NO: 62937 - DNA, 70 bp, Artificial Sequence
  Synthetic
gccaagcatttaggtgacactataggctcatttgtgctcctttgtgtttcagagctatgctggaaacagc

SEQ ID NO: 62938 - DNA, 70 bp, Artificial Sequence
  Synthetic
gccaagcatttaggtgacactatagcccaagtgtaatgctgctttgtttcagagctatgctggaaacagc

SEQ ID NO: 62939 - DNA, 70 bp, Artificial Sequence
  Synthetic
gccaagcatttaggtgacactatagaccggtcccatttgctaagtgtttcagagctatgctggaaacagc

SEQ ID NO: 62940 - DNA, 70 bp, Artificial Sequence
  Synthetic
gccaagcatttaggtgacactatagaggcaggcgctactacatgagtttcagagctatgctggaaacagc

SEQ ID NO: 62941 - DNA, 70 bp, Artificial Sequence
  Synthetic
gccaagcatttaggtgacactataggttcagttctggaaggcacggtttcagagctatgctggaaacagc

SEQ ID NO: 62942 - DNA, 70 bp, Artificial Sequence
  Synthetic
gccaagcatttaggtgacactatagcacctcacgtcacacagctggtttcagagctatgctggaaacagc

SEQ ID NO: 62943 - DNA, 70 bp, Artificial Sequence
  Synthetic
gccaagcatttaggtgacactatagttcctctttgccaatttgaagtttcagagctatgctggaaacagc

SEQ ID NO: 62944 - DNA, 70 bp, Artificial Sequence
  Synthetic
gccaagcatttaggtgacactatagtacccagtgggagagaagcagtttcagagctatgctggaaacagc

SEQ ID NO: 62945 - DNA, 70 bp, Artificial Sequence
  Synthetic
gccaagcatttaggtgacactatagaaacagctgctgtgctgaaagtttcagagctatgctggaaacagc

SEQ ID NO: 62946 - DNA, 70 bp, Artificial Sequence
  Synthetic
gccaagcatttaggtgacactatagtcctccctcgccaagggcaagtttcagagctatgctggaaacagc

SEQ ID NO: 62947 - DNA, 70 bp, Artificial Sequence
  Synthetic
gccaagcatttaggtgacactatagcaggtccgtcatttaagagtgtttcagagctatgctggaaacagc

SEQ ID NO: 62948 - DNA, 70 bp, Artificial Sequence
  Synthetic
gccaagcatttaggtgacactatagccagctgggcagctaatcatgtttcagagctatgctggaaacagc

SEQ ID NO: 62949 - DNA, 70 bp, Artificial Sequence
  Synthetic
gccaagcatttaggtgacactatagagccgcggcatcgcttctgagtttcagagctatgctggaaacagc

SEQ ID NO: 62950 - DNA, 70 bp, Artificial Sequence
  Synthetic
gccaagcatttaggtgacactatagagcatatcacttaacaacacgtttcagagctatgctggaaacagc

SEQ ID NO: 62951 - DNA, 70 bp, Artificial Sequence
  Synthetic
gccaagcatttaggtgacactataggatcacggacaggtatgcacgtttcagagctatgctggaaacagc

SEQ ID NO: 62952 - DNA, 70 bp, Artificial Sequence
  Synthetic
gccaagcatttaggtgacactatagtttagttgcttttgatgggcgtttcagagctatgctggaaacagc

SEQ ID NO: 62953 - DNA, 70 bp, Artificial Sequence
  Synthetic
gccaagcatttaggtgacactatagctcacaagtagatcctccgcgtttcagagctatgctggaaacagc

SEQ ID NO: 62954 - DNA, 70 bp, Artificial Sequence
  Synthetic
gccaagcatttaggtgacactatagggtgctgctggtgaggaagcgtttcagagctatgctggaaacagc

SEQ ID NO: 62955 - DNA, 70 bp, Artificial Sequence
  Synthetic
gccaagcatttaggtgacactataggggcctctgactgataattagtttcagagctatgctggaaacagc

SEQ ID NO: 62956 - DNA, 70 bp, Artificial Sequence
  Synthetic
gccaagcatttaggtgacactatagaatggccagagttcagacctgtttcagagctatgctggaaacagc

SEQ ID NO: 62957 - DNA, 70 bp, Artificial Sequence
  Synthetic
gccaagcatttaggtgacactatagcggggcgcgaggaggctgtggtttcagagctatgctggaaacagc

SEQ ID NO: 62958 - DNA, 70 bp, Artificial Sequence
  Synthetic
gccaagcatttaggtgacactatagtatacaatgttctctgccccgtttcagagctatgctggaaacagc

SEQ ID NO: 62959 - DNA, 70 bp, Artificial Sequence
  Synthetic
gccaagcatttaggtgacactatagatctaaggatggttcctagcgtttcagagctatgctggaaacagc

SEQ ID NO: 62960 - DNA, 70 bp, Artificial Sequence
  Synthetic
gccaagcatttaggtgacactatagggcagggaaggaggcttcaggtttcagagctatgctggaaacagc

SEQ ID NO: 62961 - DNA, 70 bp, Artificial Sequence
  Synthetic
gccaagcatttaggtgacactatagccctcagctacttccgcctggtttcagagctatgctggaaacagc

SEQ ID NO: 62962 - DNA, 70 bp, Artificial Sequence
  Synthetic
gccaagcatttaggtgacactataggacccatgtctcggggcacagtttcagagctatgctggaaacagc

SEQ ID NO: 62963 - DNA, 70 bp, Artificial Sequence
  Synthetic
gccaagcatttaggtgacactatagaagaatcttcttctggtagcgtttcagagctatgctggaaacagc

SEQ ID NO: 62964 - DNA, 70 bp, Artificial Sequence
  Synthetic
gccaagcatttaggtgacactatagggagatgggaaaaattaagcgtttcagagctatgctggaaacagc

SEQ ID NO: 62965 - DNA, 70 bp, Artificial Sequence
  Synthetic
gccaagcatttaggtgacactatagtcaggacttgaacacgtgcagtttcagagctatgctggaaacagc

SEQ ID NO: 62966 - DNA, 70 bp, Artificial Sequence
  Synthetic
gccaagcatttaggtgacactatagtgatgcttcagaagtgcatcgtttcagagctatgctggaaacagc

SEQ ID NO: 62967 - DNA, 70 bp, Artificial Sequence
  Synthetic
gccaagcatttaggtgacactataggacgagactcagctttccgcgtttcagagctatgctggaaacagc

SEQ ID NO: 62968 - DNA, 70 bp, Artificial Sequence
  Synthetic
gccaagcatttaggtgacactatagggtctggcttggtcaatgtggtttcagagctatgctggaaacagc

SEQ ID NO: 62969 - DNA, 70 bp, Artificial Sequence
  Synthetic
gccaagcatttaggtgacactatagaaatggggtggtaccgtttggtttcagagctatgctggaaacagc

SEQ ID NO: 62970 - DNA, 70 bp, Artificial Sequence
  Synthetic
gccaagcatttaggtgacactatagttcagctgatgtagatacgagtttcagagctatgctggaaacagc

SEQ ID NO: 62971 - DNA, 70 bp, Artificial Sequence
  Synthetic
gccaagcatttaggtgacactatagcatgatatttgcgcatggcggtttcagagctatgctggaaacagc

SEQ ID NO: 62972 - DNA, 70 bp, Artificial Sequence
  Synthetic
gccaagcatttaggtgacactatagactcgaggagctgtgtgaacgtttcagagctatgctggaaacagc

SEQ ID NO: 62973 - DNA, 70 bp, Artificial Sequence
  Synthetic
gccaagcatttaggtgacactataggtgcccagggaggctgagtggtttcagagctatgctggaaacagc

SEQ ID NO: 62974 - DNA, 70 bp, Artificial Sequence
  Synthetic
gccaagcatttaggtgacactatagtcgccatcttcttcttttttgtttcagagctatgctggaaacagc

SEQ ID NO: 62975 - DNA, 70 bp, Artificial Sequence
  Synthetic
gccaagcatttaggtgacactatagaacatagcaaacaatgggtagtttcagagctatgctggaaacagc

SEQ ID NO: 62976 - DNA, 70 bp, Artificial Sequence
  Synthetic
gccaagcatttaggtgacactataggtagcacttcagcttgtatcgtttcagagctatgctggaaacagc

SEQ ID NO: 62977 - DNA, 70 bp, Artificial Sequence
  Synthetic
gccaagcatttaggtgacactataggactgggtggtccaaagaatgtttcagagctatgctggaaacagc

SEQ ID NO: 62978 - DNA, 70 bp, Artificial Sequence
  Synthetic
gccaagcatttaggtgacactataggattgttctgtttcacccacgtttcagagctatgctggaaacagc

SEQ ID NO: 62979 - DNA, 70 bp, Artificial Sequence
  Synthetic
gccaagcatttaggtgacactatagacgacgaattgttctcattagtttcagagctatgctggaaacagc

SEQ ID NO: 62980 - DNA, 70 bp, Artificial Sequence
  Synthetic
gccaagcatttaggtgacactatagccgtgactccgctgctctgagtttcagagctatgctggaaacagc

SEQ ID NO: 62981 - DNA, 70 bp, Artificial Sequence
  Synthetic
gccaagcatttaggtgacactatagtatttgaaggtgtgatgaaggtttcagagctatgctggaaacagc

SEQ ID NO: 62982 - DNA, 70 bp, Artificial Sequence
  Synthetic
gccaagcatttaggtgacactatagcgcacacttccaggtgtactgtttcagagctatgctggaaacagc

SEQ ID NO: 62983 - DNA, 70 bp, Artificial Sequence
  Synthetic
gccaagcatttaggtgacactataggatgaaagtgcaggtgtgtagtttcagagctatgctggaaacagc

SEQ ID NO: 62984 - DNA, 70 bp, Artificial Sequence
  Synthetic
gccaagcatttaggtgacactatagacaggcaggtcttaggttaagtttcagagctatgctggaaacagc

SEQ ID NO: 62985 - DNA, 70 bp, Artificial Sequence
  Synthetic
gccaagcatttaggtgacactatagtccctgagggtcatctcctggtttcagagctatgctggaaacagc

SEQ ID NO: 62986 - DNA, 70 bp, Artificial Sequence
  Synthetic
gccaagcatttaggtgacactatagcacttctgccctatgtgttcgtttcagagctatgctggaaacagc

SEQ ID NO: 62987 - DNA, 70 bp, Artificial Sequence
  Synthetic
gccaagcatttaggtgacactatagccaatttccaggaagtcagagtttcagagctatgctggaaacagc

SEQ ID NO: 62988 - DNA, 70 bp, Artificial Sequence
  Synthetic
gccaagcatttaggtgacactatagatttccaattccattctcaggtttcagagctatgctggaaacagc

SEQ ID NO: 62989 - DNA, 70 bp, Artificial Sequence
  Synthetic
gccaagcatttaggtgacactatagtgctcactgctgtttctcaagtttcagagctatgctggaaacagc

SEQ ID NO: 62990 - DNA, 70 bp, Artificial Sequence
  Synthetic
gccaagcatttaggtgacactatagccaaaacaagatcctaaggagtttcagagctatgctggaaacagc

SEQ ID NO: 62991 - DNA, 70 bp, Artificial Sequence
  Synthetic
gccaagcatttaggtgacactatagtggcacccaagggcagttaggtttcagagctatgctggaaacagc

SEQ ID NO: 62992 - DNA, 70 bp, Artificial Sequence
  Synthetic
gccaagcatttaggtgacactatagcagcagtgccatctctctcagtttcagagctatgctggaaacagc

SEQ ID NO: 62993 - DNA, 70 bp, Artificial Sequence
  Synthetic
gccaagcatttaggtgacactatagtccaactcctcccgataaacgtttcagagctatgctggaaacagc

SEQ ID NO: 62994 - DNA, 70 bp, Artificial Sequence
  Synthetic
gccaagcatttaggtgacactataggaaaagtgacaaaactgagcgtttcagagctatgctggaaacagc

SEQ ID NO: 62995 - DNA, 70 bp, Artificial Sequence
  Synthetic
gccaagcatttaggtgacactataggtacttggaggatatgaaaggtttcagagctatgctggaaacagc

SEQ ID NO: 62996 - DNA, 70 bp, Artificial Sequence
  Synthetic
gccaagcatttaggtgacactatagaacagtcaaggacagtttacgtttcagagctatgctggaaacagc

SEQ ID NO: 62997 - DNA, 70 bp, Artificial Sequence
  Synthetic
gccaagcatttaggtgacactatagtgccccaacaagggtcatctgtttcagagctatgctggaaacagc

SEQ ID NO: 62998 - DNA, 70 bp, Artificial Sequence
  Synthetic
gccaagcatttaggtgacactatagacggttcaggagtaatctacgtttcagagctatgctggaaacagc

SEQ ID NO: 62999 - DNA, 70 bp, Artificial Sequence
  Synthetic
gccaagcatttaggtgacactatagaaatcagtctttccggaaaggtttcagagctatgctggaaacagc

SEQ ID NO: 63000 - DNA, 70 bp, Artificial Sequence
  Synthetic
gccaagcatttaggtgacactatagtttggggcaagctgtcgactgtttcagagctatgctggaaacagc

SEQ ID NO: 63001 - DNA, 70 bp, Artificial Sequence
  Synthetic
gccaagcatttaggtgacactatagtcctgggtgctgtgatcagagtttcagagctatgctggaaacagc

SEQ ID NO: 63002 - DNA, 70 bp, Artificial Sequence
  Synthetic
gccaagcatttaggtgacactatagaggatctatctgaggcctaggtttcagagctatgctggaaacagc

SEQ ID NO: 63003 - DNA, 70 bp, Artificial Sequence
  Synthetic
gccaagcatttaggtgacactatagttggcaaccatggttagcatgtttcagagctatgctggaaacagc

SEQ ID NO: 63004 - DNA, 70 bp, Artificial Sequence
  Synthetic
gccaagcatttaggtgacactatagccaaaaccccagggttcagcgtttcagagctatgctggaaacagc

SEQ ID NO: 63005 - DNA, 70 bp, Artificial Sequence
  Synthetic
gccaagcatttaggtgacactatagccaaaaccccagggtttggcgtttcagagctatgctggaaacagc

SEQ ID NO: 63006 - DNA, 70 bp, Artificial Sequence
  Synthetic
gccaagcatttaggtgacactataggccaggaagaacggcatgatgtttcagagctatgctggaaacagc

SEQ ID NO: 63007 - DNA, 70 bp, Artificial Sequence
  Synthetic
gccaagcatttaggtgacactatagctaggagacgccaatattcagtttcagagctatgctggaaacagc

SEQ ID NO: 63008 - DNA, 70 bp, Artificial Sequence
  Synthetic
gccaagcatttaggtgacactataggacttctatttaccgcacgcgtttcagagctatgctggaaacagc

SEQ ID NO: 63009 - DNA, 70 bp, Artificial Sequence
  Synthetic
gccaagcatttaggtgacactatagaccgcagcggcgacagctgagtttcagagctatgctggaaacagc

SEQ ID NO: 63010 - DNA, 70 bp, Artificial Sequence
  Synthetic
gccaagcatttaggtgacactatagagtccagctggaagcttgaggtttcagagctatgctggaaacagc

SEQ ID NO: 63011 - DNA, 70 bp, Artificial Sequence
  Synthetic
gccaagcatttaggtgacactatagagccagcaatgcaaattgatgtttcagagctatgctggaaacagc

SEQ ID NO: 63012 - DNA, 70 bp, Artificial Sequence
  Synthetic
gccaagcatttaggtgacactataggccaccggctgcaaatgaaggtttcagagctatgctggaaacagc

SEQ ID NO: 63013 - DNA, 70 bp, Artificial Sequence
  Synthetic
gccaagcatttaggtgacactataggtggggctgtccaagtgaccgtttcagagctatgctggaaacagc

SEQ ID NO: 63014 - DNA, 70 bp, Artificial Sequence
  Synthetic
gccaagcatttaggtgacactatagctcacagtggatatggagatgtttcagagctatgctggaaacagc

SEQ ID NO: 63015 - DNA, 70 bp, Artificial Sequence
  Synthetic
gccaagcatttaggtgacactatagtatttaaggaggtctcaactgtttcagagctatgctggaaacagc

SEQ ID NO: 63016 - DNA, 70 bp, Artificial Sequence
  Synthetic
gccaagcatttaggtgacactataggtgggcagggcagacggcttgtttcagagctatgctggaaacagc

SEQ ID NO: 63017 - DNA, 70 bp, Artificial Sequence
  Synthetic
gccaagcatttaggtgacactataggaaagcaaggagacggcatcgtttcagagctatgctggaaacagc

SEQ ID NO: 63018 - DNA, 70 bp, Artificial Sequence
  Synthetic
gccaagcatttaggtgacactatagggttctgactcagagtgacagtttcagagctatgctggaaacagc

SEQ ID NO: 63019 - DNA, 70 bp, Artificial Sequence
  Synthetic
gccaagcatttaggtgacactataggagaagtgcattgatgtgaggtttcagagctatgctggaaacagc

SEQ ID NO: 63020 - DNA, 70 bp, Artificial Sequence
  Synthetic
gccaagcatttaggtgacactatagatccacagatgcagaataacgtttcagagctatgctggaaacagc

SEQ ID NO: 63021 - DNA, 70 bp, Artificial Sequence
  Synthetic
gccaagcatttaggtgacactatagtcatgttgcacaatccctaagtttcagagctatgctggaaacagc

SEQ ID NO: 63022 - DNA, 70 bp, Artificial Sequence
  Synthetic
gccaagcatttaggtgacactatagcatctatcccactgtggatcgtttcagagctatgctggaaacagc

SEQ ID NO: 63023 - DNA, 70 bp, Artificial Sequence
  Synthetic
gccaagcatttaggtgacactatagcttctcatactcgctgatgagtttcagagctatgctggaaacagc

SEQ ID NO: 63024 - DNA, 70 bp, Artificial Sequence
  Synthetic
gccaagcatttaggtgacactataggatcacagcccaagtatcacgtttcagagctatgctggaaacagc

SEQ ID NO: 63025 - DNA, 70 bp, Artificial Sequence
  Synthetic
gccaagcatttaggtgacactataggtgggaataaaaccaaccacgtttcagagctatgctggaaacagc

SEQ ID NO: 63026 - DNA, 70 bp, Artificial Sequence
  Synthetic
gccaagcatttaggtgacactatagtgagtccaagctggctctaggtttcagagctatgctggaaacagc

SEQ ID NO: 63027 - DNA, 70 bp, Artificial Sequence
  Synthetic
gccaagcatttaggtgacactatagaaatggggtatcagagacctgtttcagagctatgctggaaacagc

SEQ ID NO: 63028 - DNA, 70 bp, Artificial Sequence
  Synthetic
gccaagcatttaggtgacactatagacagctggttctaaatatgagtttcagagctatgctggaaacagc

SEQ ID NO: 63029 - DNA, 70 bp, Artificial Sequence
  Synthetic
gccaagcatttaggtgacactataggaactcaagaaaagatacgggtttcagagctatgctggaaacagc

SEQ ID NO: 63030 - DNA, 70 bp, Artificial Sequence
  Synthetic
gccaagcatttaggtgacactatagatcattaagtttcacggcctgtttcagagctatgctggaaacagc

SEQ ID NO: 63031 - DNA, 70 bp, Artificial Sequence
  Synthetic
gccaagcatttaggtgacactatagcactgtccataaatgtgcaggtttcagagctatgctggaaacagc

SEQ ID NO: 63032 - DNA, 70 bp, Artificial Sequence
  Synthetic
gccaagcatttaggtgacactatagctcagaaacgttctcttgatgtttcagagctatgctggaaacagc

SEQ ID NO: 63033 - DNA, 70 bp, Artificial Sequence
  Synthetic
gccaagcatttaggtgacactataggcacatttatggacagtgtcgtttcagagctatgctggaaacagc

SEQ ID NO: 63034 - DNA, 70 bp, Artificial Sequence
  Synthetic
gccaagcatttaggtgacactatagaacatccctgtcacctttcagtttcagagctatgctggaaacagc

SEQ ID NO: 63035 - DNA, 70 bp, Artificial Sequence
  Synthetic
gccaagcatttaggtgacactatagtaataggttgatcacagatcgtttcagagctatgctggaaacagc

SEQ ID NO: 63036 - DNA, 70 bp, Artificial Sequence
  Synthetic
gccaagcatttaggtgacactatagttctacttgtatccatttccgtttcagagctatgctggaaacagc

SEQ ID NO: 63037 - DNA, 70 bp, Artificial Sequence
  Synthetic
gccaagcatttaggtgacactatagtgaagaagcgacctgcagaagtttcagagctatgctggaaacagc

SEQ ID NO: 63038 - DNA, 70 bp, Artificial Sequence
  Synthetic
gccaagcatttaggtgacactatagcatcaggttccaaaaagttcgtttcagagctatgctggaaacagc

SEQ ID NO: 63039 - DNA, 70 bp, Artificial Sequence
  Synthetic
gccaagcatttaggtgacactatagcttctctctgtatttgttgggtttcagagctatgctggaaacagc

SEQ ID NO: 63040 - DNA, 70 bp, Artificial Sequence
  Synthetic
gccaagcatttaggtgacactatagtgtcctccatgctatttacagtttcagagctatgctggaaacagc

SEQ ID NO: 63041 - DNA, 70 bp, Artificial Sequence
  Synthetic
gccaagcatttaggtgacactatagacagcatgcccgcaagcagggtttcagagctatgctggaaacagc

SEQ ID NO: 63042 - DNA, 70 bp, Artificial Sequence
  Synthetic
gccaagcatttaggtgacactataggcaatacagagatgacttgggtttcagagctatgctggaaacagc

SEQ ID NO: 63043 - DNA, 70 bp, Artificial Sequence
  Synthetic
gccaagcatttaggtgacactataggcaggccttttactttgagtgtttcagagctatgctggaaacagc

SEQ ID NO: 63044 - DNA, 70 bp, Artificial Sequence
  Synthetic
gccaagcatttaggtgacactataggaaccacgtgtcaagtgattgtttcagagctatgctggaaacagc

SEQ ID NO: 63045 - DNA, 70 bp, Artificial Sequence
  Synthetic
gccaagcatttaggtgacactatagccctccagctgcctgggctggtttcagagctatgctggaaacagc

SEQ ID NO: 63046 - DNA, 70 bp, Artificial Sequence
  Synthetic
gccaagcatttaggtgacactatagtccttgcagggtcaacagaagtttcagagctatgctggaaacagc

SEQ ID NO: 63047 - DNA, 70 bp, Artificial Sequence
  Synthetic
gccaagcatttaggtgacactatagacaactcagccctgctcatggtttcagagctatgctggaaacagc

SEQ ID NO: 63048 - DNA, 70 bp, Artificial Sequence
  Synthetic
gccaagcatttaggtgacactatagtgcggatggacatgataactgtttcagagctatgctggaaacagc

SEQ ID NO: 63049 - DNA, 70 bp, Artificial Sequence
  Synthetic
gccaagcatttaggtgacactatagggcgggccctgcactcatgagtttcagagctatgctggaaacagc

SEQ ID NO: 63050 - DNA, 70 bp, Artificial Sequence
  Synthetic
gccaagcatttaggtgacactatagaagccccagcgcctatattagtttcagagctatgctggaaacagc

SEQ ID NO: 63051 - DNA, 70 bp, Artificial Sequence
  Synthetic
gccaagcatttaggtgacactatagggcgggttctgcactcatgagtttcagagctatgctggaaacagc

SEQ ID NO: 63052 - DNA, 70 bp, Artificial Sequence
  Synthetic
gccaagcatttaggtgacactataggaaacgggaatttatttgccgtttcagagctatgctggaaacagc

SEQ ID NO: 63053 - DNA, 70 bp, Artificial Sequence
  Synthetic
gccaagcatttaggtgacactatagttcctttgtgcttaactggcgtttcagagctatgctggaaacagc

SEQ ID NO: 63054 - DNA, 70 bp, Artificial Sequence
  Synthetic
gccaagcatttaggtgacactatagagccaaggaagccgcagaacgtttcagagctatgctggaaacagc

SEQ ID NO: 63055 - DNA, 70 bp, Artificial Sequence
  Synthetic
gccaagcatttaggtgacactatagcctcaagacccacggactccgtttcagagctatgctggaaacagc

SEQ ID NO: 63056 - DNA, 70 bp, Artificial Sequence
  Synthetic
gccaagcatttaggtgacactatagatctggcaagaaagcataaggtttcagagctatgctggaaacagc

SEQ ID NO: 63057 - DNA, 70 bp, Artificial Sequence
  Synthetic
gccaagcatttaggtgacactatagtgctcaaacccgggagacaggtttcagagctatgctggaaacagc

SEQ ID NO: 63058 - DNA, 70 bp, Artificial Sequence
  Synthetic
gccaagcatttaggtgacactatagacttatattagcggtaacgggtttcagagctatgctggaaacagc

SEQ ID NO: 63059 - DNA, 70 bp, Artificial Sequence
  Synthetic
gccaagcatttaggtgacactatagtgagatgatccttacggaaagtttcagagctatgctggaaacagc

SEQ ID NO: 63060 - DNA, 70 bp, Artificial Sequence
  Synthetic
gccaagcatttaggtgacactatagcccccttcgttagtcgtatagtttcagagctatgctggaaacagc

SEQ ID NO: 63061 - DNA, 70 bp, Artificial Sequence
  Synthetic
gccaagcatttaggtgacactatagagggttagtttttgtagcctgtttcagagctatgctggaaacagc

SEQ ID NO: 63062 - DNA, 70 bp, Artificial Sequence
  Synthetic
gccaagcatttaggtgacactataggaggcccaacaccttcttctgtttcagagctatgctggaaacagc

SEQ ID NO: 63063 - DNA, 70 bp, Artificial Sequence
  Synthetic
gccaagcatttaggtgacactatagaagtgggaggttttatttctgtttcagagctatgctggaaacagc

SEQ ID NO: 63064 - DNA, 70 bp, Artificial Sequence
  Synthetic
gccaagcatttaggtgacactatagcgaagaagaggaggaagacggtttcagagctatgctggaaacagc

SEQ ID NO: 63065 - DNA, 70 bp, Artificial Sequence
  Synthetic
gccaagcatttaggtgacactataggatggtggtgccactacttcgtttcagagctatgctggaaacagc

SEQ ID NO: 63066 - DNA, 70 bp, Artificial Sequence
  Synthetic
gccaagcatttaggtgacactatagtcatgcaatgctgccagcatgtttcagagctatgctggaaacagc

SEQ ID NO: 63067 - DNA, 70 bp, Artificial Sequence
  Synthetic
gccaagcatttaggtgacactatagggctcctgattacgatgcttgtttcagagctatgctggaaacagc

SEQ ID NO: 63068 - DNA, 70 bp, Artificial Sequence
  Synthetic
gccaagcatttaggtgacactataggttggtggaaaacgctaaacgtttcagagctatgctggaaacagc

SEQ ID NO: 63069 - DNA, 70 bp, Artificial Sequence
  Synthetic
gccaagcatttaggtgacactatagagaaaccattgagaagatgcgtttcagagctatgctggaaacagc

SEQ ID NO: 63070 - DNA, 70 bp, Artificial Sequence
  Synthetic
gccaagcatttaggtgacactatagcgacaagttggaaaagagaagtttcagagctatgctggaaacagc

SEQ ID NO: 63071 - DNA, 70 bp, Artificial Sequence
  Synthetic
gccaagcatttaggtgacactatagagtggttcttccagaaactggtttcagagctatgctggaaacagc

SEQ ID NO: 63072 - DNA, 70 bp, Artificial Sequence
  Synthetic
gccaagcatttaggtgacactatagccatgtggcttcaagccaccgtttcagagctatgctggaaacagc

SEQ ID NO: 63073 - DNA, 70 bp, Artificial Sequence
  Synthetic
gccaagcatttaggtgacactataggggcggcttgtggagtgtatgtttcagagctatgctggaaacagc

SEQ ID NO: 63074 - DNA, 70 bp, Artificial Sequence
  Synthetic
gccaagcatttaggtgacactataggcagggggctcaggagctctgtttcagagctatgctggaaacagc

SEQ ID NO: 63075 - DNA, 70 bp, Artificial Sequence
  Synthetic
gccaagcatttaggtgacactatagaaaatcacagctcccagaccgtttcagagctatgctggaaacagc

SEQ ID NO: 63076 - DNA, 70 bp, Artificial Sequence
  Synthetic
gccaagcatttaggtgacactatagattcctacaatcaggatttggtttcagagctatgctggaaacagc

SEQ ID NO: 63077 - DNA, 70 bp, Artificial Sequence
  Synthetic
gccaagcatttaggtgacactataggtgtcgtggtggtcattaaggtttcagagctatgctggaaacagc

SEQ ID NO: 63078 - DNA, 70 bp, Artificial Sequence
  Synthetic
gccaagcatttaggtgacactatagatctactctgaagcctttgtgtttcagagctatgctggaaacagc

SEQ ID NO: 63079 - DNA, 70 bp, Artificial Sequence
  Synthetic
gccaagcatttaggtgacactataggaccgaattgcaaaggaagagtttcagagctatgctggaaacagc

SEQ ID NO: 63080 - DNA, 70 bp, Artificial Sequence
  Synthetic
gccaagcatttaggtgacactatagagaagcatgccagaacagacgtttcagagctatgctggaaacagc

SEQ ID NO: 63081 - DNA, 70 bp, Artificial Sequence
  Synthetic
gccaagcatttaggtgacactataggctgtccagaaaacgtaatggtttcagagctatgctggaaacagc

SEQ ID NO: 63082 - DNA, 70 bp, Artificial Sequence
  Synthetic
gccaagcatttaggtgacactatagtccaggagggctccctttatgtttcagagctatgctggaaacagc

SEQ ID NO: 63083 - DNA, 70 bp, Artificial Sequence
  Synthetic
gccaagcatttaggtgacactataggcgcagtgaagaaaatgagtgtttcagagctatgctggaaacagc

SEQ ID NO: 63084 - DNA, 70 bp, Artificial Sequence
  Synthetic
gccaagcatttaggtgacactatagaatcgttgtgaaagtgttgagtttcagagctatgctggaaacagc

SEQ ID NO: 63085 - DNA, 70 bp, Artificial Sequence
  Synthetic
gccaagcatttaggtgacactataggtacgcggtcaaggcctgaggtttcagagctatgctggaaacagc

SEQ ID NO: 63086 - DNA, 70 bp, Artificial Sequence
  Synthetic
gccaagcatttaggtgacactataggagtgatgctgtacccctcagtttcagagctatgctggaaacagc

SEQ ID NO: 63087 - DNA, 70 bp, Artificial Sequence
  Synthetic
gccaagcatttaggtgacactataggggaggggctcagtctttctgtttcagagctatgctggaaacagc

SEQ ID NO: 63088 - DNA, 70 bp, Artificial Sequence
  Synthetic
gccaagcatttaggtgacactatagatatccttacggcaattaacgtttcagagctatgctggaaacagc

SEQ ID NO: 63089 - DNA, 70 bp, Artificial Sequence
  Synthetic
gccaagcatttaggtgacactatagtaagccgattttccggaaaagtttcagagctatgctggaaacagc

SEQ ID NO: 63090 - DNA, 70 bp, Artificial Sequence
  Synthetic
gccaagcatttaggtgacactatagaagtttagaactggatcactgtttcagagctatgctggaaacagc

SEQ ID NO: 63091 - DNA, 70 bp, Artificial Sequence
  Synthetic
gccaagcatttaggtgacactatagtgctgcaacagctgccctctgtttcagagctatgctggaaacagc

SEQ ID NO: 63092 - DNA, 70 bp, Artificial Sequence
  Synthetic
gccaagcatttaggtgacactatagaagagtagaggagcgtctacgtttcagagctatgctggaaacagc

SEQ ID NO: 63093 - DNA, 70 bp, Artificial Sequence
  Synthetic
gccaagcatttaggtgacactatagagttccttcactgccaaaccgtttcagagctatgctggaaacagc

SEQ ID NO: 63094 - DNA, 70 bp, Artificial Sequence
  Synthetic
gccaagcatttaggtgacactatagcagtggattcggatgaaaacgtttcagagctatgctggaaacagc

SEQ ID NO: 63095 - DNA, 70 bp, Artificial Sequence
  Synthetic
gccaagcatttaggtgacactataggcattggagaagaaccaagcgtttcagagctatgctggaaacagc

SEQ ID NO: 63096 - DNA, 70 bp, Artificial Sequence
  Synthetic
gccaagcatttaggtgacactatagggagacctcgggagacttgtgtttcagagctatgctggaaacagc

SEQ ID NO: 63097 - DNA, 70 bp, Artificial Sequence
  Synthetic
gccaagcatttaggtgacactatagagagaagaaacctactacaggtttcagagctatgctggaaacagc

SEQ ID NO: 63098 - DNA, 70 bp, Artificial Sequence
  Synthetic
gccaagcatttaggtgacactatagcccatgttggtcctctgcccgtttcagagctatgctggaaacagc

SEQ ID NO: 63099 - DNA, 70 bp, Artificial Sequence
  Synthetic
gccaagcatttaggtgacactatagcttcctcagagctcaggagcgtttcagagctatgctggaaacagc

SEQ ID NO: 63100 - DNA, 70 bp, Artificial Sequence
  Synthetic
gccaagcatttaggtgacactatagtctgtgtttgctctgacgaagtttcagagctatgctggaaacagc

SEQ ID NO: 63101 - DNA, 70 bp, Artificial Sequence
  Synthetic
gccaagcatttaggtgacactatagtttttcttcattccacctcggtttcagagctatgctggaaacagc

SEQ ID NO: 63102 - DNA, 70 bp, Artificial Sequence
  Synthetic
gccaagcatttaggtgacactatagcgccaagctcgaaaaggcaagtttcagagctatgctggaaacagc

SEQ ID NO: 63103 - DNA, 70 bp, Artificial Sequence
  Synthetic
gccaagcatttaggtgacactatagcctgggtctagttcagctgagtttcagagctatgctggaaacagc

SEQ ID NO: 63104 - DNA, 70 bp, Artificial Sequence
  Synthetic
gccaagcatttaggtgacactatagccggggaaccaagactgtgcgtttcagagctatgctggaaacagc

SEQ ID NO: 63105 - DNA, 70 bp, Artificial Sequence
  Synthetic
gccaagcatttaggtgacactatagtgaaaaaggaactgttcagcgtttcagagctatgctggaaacagc

SEQ ID NO: 63106 - DNA, 70 bp, Artificial Sequence
  Synthetic
gccaagcatttaggtgacactatagtcggacgaggatatgggattgtttcagagctatgctggaaacagc

SEQ ID NO: 63107 - DNA, 70 bp, Artificial Sequence
  Synthetic
gccaagcatttaggtgacactatagtctgatgatgacatgggcttgtttcagagctatgctggaaacagc

SEQ ID NO: 63108 - DNA, 70 bp, Artificial Sequence
  Synthetic
gccaagcatttaggtgacactatagtcagatgatgacatgggattgtttcagagctatgctggaaacagc

SEQ ID NO: 63109 - DNA, 70 bp, Artificial Sequence
  Synthetic
gccaagcatttaggtgacactatagaggatgcgggcaggggctacgtttcagagctatgctggaaacagc

SEQ ID NO: 63110 - DNA, 70 bp, Artificial Sequence
  Synthetic
gccaagcatttaggtgacactatagcaatcggatgctggcccagcgtttcagagctatgctggaaacagc

SEQ ID NO: 63111 - DNA, 70 bp, Artificial Sequence
  Synthetic
gccaagcatttaggtgacactatagtgcagagcagagcagtagatgtttcagagctatgctggaaacagc

SEQ ID NO: 63112 - DNA, 70 bp, Artificial Sequence
  Synthetic
gccaagcatttaggtgacactatagtttcaggatttggaagcttcgtttcagagctatgctggaaacagc

SEQ ID NO: 63113 - DNA, 70 bp, Artificial Sequence
  Synthetic
gccaagcatttaggtgacactatagagatggggtgaatccatcacgtttcagagctatgctggaaacagc

SEQ ID NO: 63114 - DNA, 70 bp, Artificial Sequence
  Synthetic
gccaagcatttaggtgacactatagtctgcattttctcctcaggagtttcagagctatgctggaaacagc

SEQ ID NO: 63115 - DNA, 70 bp, Artificial Sequence
  Synthetic
gccaagcatttaggtgacactatagggttgcggacgaggatcagagtttcagagctatgctggaaacagc

SEQ ID NO: 63116 - DNA, 70 bp, Artificial Sequence
  Synthetic
gccaagcatttaggtgacactataggctcagcaggtcttcacgatgtttcagagctatgctggaaacagc

SEQ ID NO: 63117 - DNA, 70 bp, Artificial Sequence
  Synthetic
gccaagcatttaggtgacactataggaagggtcaaagcctgttctgtttcagagctatgctggaaacagc

SEQ ID NO: 63118 - DNA, 70 bp, Artificial Sequence
  Synthetic
gccaagcatttaggtgacactatagtccaagaaagccaagtgtgagtttcagagctatgctggaaacagc

SEQ ID NO: 63119 - DNA, 70 bp, Artificial Sequence
  Synthetic
gccaagcatttaggtgacactatagaaagcttgctgacggtcggcgtttcagagctatgctggaaacagc

SEQ ID NO: 63120 - DNA, 70 bp, Artificial Sequence
  Synthetic
gccaagcatttaggtgacactatagttggcttcagatggctgttggtttcagagctatgctggaaacagc

SEQ ID NO: 63121 - DNA, 70 bp, Artificial Sequence
  Synthetic
gccaagcatttaggtgacactatagacatctacagtgaagattgagtttcagagctatgctggaaacagc

SEQ ID NO: 63122 - DNA, 70 bp, Artificial Sequence
  Synthetic
gccaagcatttaggtgacactatagtgcagagaaagagcataaatgtttcagagctatgctggaaacagc

SEQ ID NO: 63123 - DNA, 70 bp, Artificial Sequence
  Synthetic
gccaagcatttaggtgacactatagctgttttcaactgactaggagtttcagagctatgctggaaacagc

SEQ ID NO: 63124 - DNA, 70 bp, Artificial Sequence
  Synthetic
gccaagcatttaggtgacactatagcttaaattcaatcgtcgacggtttcagagctatgctggaaacagc

SEQ ID NO: 63125 - DNA, 70 bp, Artificial Sequence
  Synthetic
gccaagcatttaggtgacactatagtcttccctcccaggtactgagtttcagagctatgctggaaacagc

SEQ ID NO: 63126 - DNA, 70 bp, Artificial Sequence
  Synthetic
gccaagcatttaggtgacactatagggggcagagggcgggtcagtgtttcagagctatgctggaaacagc

SEQ ID NO: 63127 - DNA, 70 bp, Artificial Sequence
  Synthetic
gccaagcatttaggtgacactatagatggcgctcagtacagccccgtttcagagctatgctggaaacagc

SEQ ID NO: 63128 - DNA, 70 bp, Artificial Sequence
  Synthetic
gccaagcatttaggtgacactatagggcggatttggtcgtggacggtttcagagctatgctggaaacagc

SEQ ID NO: 63129 - DNA, 70 bp, Artificial Sequence
  Synthetic
gccaagcatttaggtgacactatagaagcagttccagaagttctggtttcagagctatgctggaaacagc

SEQ ID NO: 63130 - DNA, 70 bp, Artificial Sequence
  Synthetic
gccaagcatttaggtgacactatagatactcttcaatgacatcctgtttcagagctatgctggaaacagc

SEQ ID NO: 63131 - DNA, 70 bp, Artificial Sequence
  Synthetic
gccaagcatttaggtgacactatagacagacaaatttatgcgaccgtttcagagctatgctggaaacagc

SEQ ID NO: 63132 - DNA, 70 bp, Artificial Sequence
  Synthetic
gccaagcatttaggtgacactatagtgaggaatcttgttcacagagtttcagagctatgctggaaacagc

SEQ ID NO: 63133 - DNA, 70 bp, Artificial Sequence
  Synthetic
gccaagcatttaggtgacactataggcttcatccctctcaagtaagtttcagagctatgctggaaacagc

SEQ ID NO: 63134 - DNA, 70 bp, Artificial Sequence
  Synthetic
gccaagcatttaggtgacactatagaatcctgggattctttttctgtttcagagctatgctggaaacagc

SEQ ID NO: 63135 - DNA, 70 bp, Artificial Sequence
  Synthetic
gccaagcatttaggtgacactatagttgagtcacgatgggcttatgtttcagagctatgctggaaacagc

SEQ ID NO: 63136 - DNA, 70 bp, Artificial Sequence
  Synthetic
gccaagcatttaggtgacactatagaaaattcaaacaggtccccggtttcagagctatgctggaaacagc

SEQ ID NO: 63137 - DNA, 70 bp, Artificial Sequence
  Synthetic
gccaagcatttaggtgacactatagtttcttcttggacacacccagtttcagagctatgctggaaacagc

SEQ ID NO: 63138 - DNA, 70 bp, Artificial Sequence
  Synthetic
gccaagcatttaggtgacactatagggcaatttattaacccagcagtttcagagctatgctggaaacagc

SEQ ID NO: 63139 - DNA, 70 bp, Artificial Sequence
  Synthetic
gccaagcatttaggtgacactataggttggcagctgccacctgtcgtttcagagctatgctggaaacagc

SEQ ID NO: 63140 - DNA, 70 bp, Artificial Sequence
  Synthetic
gccaagcatttaggtgacactataggcaggaatacttcggcagctgtttcagagctatgctggaaacagc

SEQ ID NO: 63141 - DNA, 70 bp, Artificial Sequence
  Synthetic
gccaagcatttaggtgacactataggcggactcaggctccagctggtttcagagctatgctggaaacagc

SEQ ID NO: 63142 - DNA, 70 bp, Artificial Sequence
  Synthetic
gccaagcatttaggtgacactataggttgacttaagcatctgcaagtttcagagctatgctggaaacagc

SEQ ID NO: 63143 - DNA, 70 bp, Artificial Sequence
  Synthetic
gccaagcatttaggtgacactatagggaggagaatgcagttaaaagtttcagagctatgctggaaacagc

SEQ ID NO: 63144 - DNA, 70 bp, Artificial Sequence
  Synthetic
gccaagcatttaggtgacactatagctccgattggccaaggccgagtttcagagctatgctggaaacagc

SEQ ID NO: 63145 - DNA, 70 bp, Artificial Sequence
  Synthetic
gccaagcatttaggtgacactatagggccctatacaaaggcaagagtttcagagctatgctggaaacagc

SEQ ID NO: 63146 - DNA, 70 bp, Artificial Sequence
  Synthetic
gccaagcatttaggtgacactataggcaaaaagccgaaggagtaagtttcagagctatgctggaaacagc

SEQ ID NO: 63147 - DNA, 70 bp, Artificial Sequence
  Synthetic
gccaagcatttaggtgacactatagggccatggcagtgacattaggtttcagagctatgctggaaacagc

SEQ ID NO: 63148 - DNA, 70 bp, Artificial Sequence
  Synthetic
gccaagcatttaggtgacactataggcaaaggccaatgttggtgcgtttcagagctatgctggaaacagc

SEQ ID NO: 63149 - DNA, 70 bp, Artificial Sequence
  Synthetic
gccaagcatttaggtgacactataggctggtgaagatgcatgaatgtttcagagctatgctggaaacagc

SEQ ID NO: 63150 - DNA, 70 bp, Artificial Sequence
  Synthetic
gccaagcatttaggtgacactatagccgatgcgtgcccaaggacagtttcagagctatgctggaaacagc

SEQ ID NO: 63151 - DNA, 70 bp, Artificial Sequence
  Synthetic
gccaagcatttaggtgacactataggtggtgattttatagcatccgtttcagagctatgctggaaacagc

SEQ ID NO: 63152 - DNA, 70 bp, Artificial Sequence
  Synthetic
gccaagcatttaggtgacactatagttagtgctgcttcctcctgagtttcagagctatgctggaaacagc

SEQ ID NO: 63153 - DNA, 70 bp, Artificial Sequence
  Synthetic
gccaagcatttaggtgacactatagtcatacagttacttgtcttcgtttcagagctatgctggaaacagc

SEQ ID NO: 63154 - DNA, 70 bp, Artificial Sequence
  Synthetic
gccaagcatttaggtgacactatagggaaaggccagactcacagagtttcagagctatgctggaaacagc

SEQ ID NO: 63155 - DNA, 70 bp, Artificial Sequence
  Synthetic
gccaagcatttaggtgacactataggccaagctcagcgcaacctcgtttcagagctatgctggaaacagc

SEQ ID NO: 63156 - DNA, 70 bp, Artificial Sequence
  Synthetic
gccaagcatttaggtgacactatagattcactttctgcactgtgcgtttcagagctatgctggaaacagc

SEQ ID NO: 63157 - DNA, 70 bp, Artificial Sequence
  Synthetic
gccaagcatttaggtgacactatagcgtcagtacgcgaaggatatgtttcagagctatgctggaaacagc

SEQ ID NO: 63158 - DNA, 70 bp, Artificial Sequence
  Synthetic
gccaagcatttaggtgacactatagccagtccccacagcataacagtttcagagctatgctggaaacagc

SEQ ID NO: 63159 - DNA, 70 bp, Artificial Sequence
  Synthetic
gccaagcatttaggtgacactataggttatgctgtggggactggcgtttcagagctatgctggaaacagc

SEQ ID NO: 63160 - DNA, 70 bp, Artificial Sequence
  Synthetic
gccaagcatttaggtgacactataggctaaagttgaacgagctgagtttcagagctatgctggaaacagc

SEQ ID NO: 63161 - DNA, 70 bp, Artificial Sequence
  Synthetic
gccaagcatttaggtgacactatagagtcatttgtctgcacctctgtttcagagctatgctggaaacagc

SEQ ID NO: 63162 - DNA, 70 bp, Artificial Sequence
  Synthetic
gccaagcatttaggtgacactatagaaacagagcagtgggtgaaagtttcagagctatgctggaaacagc

SEQ ID NO: 63163 - DNA, 70 bp, Artificial Sequence
  Synthetic
gccaagcatttaggtgacactatagctggccaccaaacagagcaggtttcagagctatgctggaaacagc

SEQ ID NO: 63164 - DNA, 70 bp, Artificial Sequence
  Synthetic
gccaagcatttaggtgacactatagctggctgccaaacagagcaggtttcagagctatgctggaaacagc

SEQ ID NO: 63165 - DNA, 70 bp, Artificial Sequence
  Synthetic
gccaagcatttaggtgacactataggcagcagctgggaaaatcaggtttcagagctatgctggaaacagc

SEQ ID NO: 63166 - DNA, 70 bp, Artificial Sequence
  Synthetic
gccaagcatttaggtgacactatagagaagtagaagctcgcagaggtttcagagctatgctggaaacagc

SEQ ID NO: 63167 - DNA, 70 bp, Artificial Sequence
  Synthetic
gccaagcatttaggtgacactatagcgaatgccctggtgcctcacgtttcagagctatgctggaaacagc

SEQ ID NO: 63168 - DNA, 70 bp, Artificial Sequence
  Synthetic
gccaagcatttaggtgacactatagcacgtccacgcggctgtagcgtttcagagctatgctggaaacagc

SEQ ID NO: 63169 - DNA, 70 bp, Artificial Sequence
  Synthetic
gccaagcatttaggtgacactatagtctcactgaggtcacttcacgtttcagagctatgctggaaacagc

SEQ ID NO: 63170 - DNA, 70 bp, Artificial Sequence
  Synthetic
gccaagcatttaggtgacactatagtcacagtggtggggattagggtttcagagctatgctggaaacagc

SEQ ID NO: 63171 - DNA, 70 bp, Artificial Sequence
  Synthetic
gccaagcatttaggtgacactatagatccagtgattttatacctcgtttcagagctatgctggaaacagc

SEQ ID NO: 63172 - DNA, 70 bp, Artificial Sequence
  Synthetic
gccaagcatttaggtgacactataggttctcggactcagtagcttgtttcagagctatgctggaaacagc

SEQ ID NO: 63173 - DNA, 70 bp, Artificial Sequence
  Synthetic
gccaagcatttaggtgacactatagaggaacaccacaaatcttacgtttcagagctatgctggaaacagc

SEQ ID NO: 63174 - DNA, 70 bp, Artificial Sequence
  Synthetic
gccaagcatttaggtgacactatagcgatcacctcgaagatttatgtttcagagctatgctggaaacagc

SEQ ID NO: 63175 - DNA, 70 bp, Artificial Sequence
  Synthetic
gccaagcatttaggtgacactatagtctgtcatagattcatacgcgtttcagagctatgctggaaacagc

SEQ ID NO: 63176 - DNA, 70 bp, Artificial Sequence
  Synthetic
gccaagcatttaggtgacactatagccgtgggcgtccagggcgctgtttcagagctatgctggaaacagc

SEQ ID NO: 63177 - DNA, 70 bp, Artificial Sequence
  Synthetic
gccaagcatttaggtgacactatagattttttacccctgtggattgtttcagagctatgctggaaacagc

SEQ ID NO: 63178 - DNA, 70 bp, Artificial Sequence
  Synthetic
gccaagcatttaggtgacactatagagcaagctggtggggtaagagtttcagagctatgctggaaacagc

SEQ ID NO: 63179 - DNA, 70 bp, Artificial Sequence
  Synthetic
gccaagcatttaggtgacactatagctataagaagctcacgggcagtttcagagctatgctggaaacagc

SEQ ID NO: 63180 - DNA, 70 bp, Artificial Sequence
  Synthetic
gccaagcatttaggtgacactatagaaggatttatttgcctttgcgtttcagagctatgctggaaacagc

SEQ ID NO: 63181 - DNA, 70 bp, Artificial Sequence
  Synthetic
gccaagcatttaggtgacactatagggctggagacgacgaggagggtttcagagctatgctggaaacagc

SEQ ID NO: 63182 - DNA, 70 bp, Artificial Sequence
  Synthetic
gccaagcatttaggtgacactatagggatgttcaccacctgcttggtttcagagctatgctggaaacagc

SEQ ID NO: 63183 - DNA, 70 bp, Artificial Sequence
  Synthetic
gccaagcatttaggtgacactatagctggagcgctcagcctgccagtttcagagctatgctggaaacagc

SEQ ID NO: 63184 - DNA, 70 bp, Artificial Sequence
  Synthetic
gccaagcatttaggtgacactatagtttgcctgtctcatctctgagtttcagagctatgctggaaacagc

SEQ ID NO: 63185 - DNA, 70 bp, Artificial Sequence
  Synthetic
gccaagcatttaggtgacactatagtggagaagcgtgtcagataggtttcagagctatgctggaaacagc

SEQ ID NO: 63186 - DNA, 70 bp, Artificial Sequence
  Synthetic
gccaagcatttaggtgacactatagccccacggctctcagctgtcgtttcagagctatgctggaaacagc

SEQ ID NO: 63187 - DNA, 70 bp, Artificial Sequence
  Synthetic
gccaagcatttaggtgacactataggagcggcttcagcagcacttgtttcagagctatgctggaaacagc

SEQ ID NO: 63188 - DNA, 70 bp, Artificial Sequence
  Synthetic
gccaagcatttaggtgacactatagatgactggcaaaaggactgagtttcagagctatgctggaaacagc

SEQ ID NO: 63189 - DNA, 70 bp, Artificial Sequence
  Synthetic
gccaagcatttaggtgacactatagagagggaggactattgtaaggtttcagagctatgctggaaacagc

SEQ ID NO: 63190 - DNA, 70 bp, Artificial Sequence
  Synthetic
gccaagcatttaggtgacactataggtctgaggagggcttcatccgtttcagagctatgctggaaacagc

SEQ ID NO: 63191 - DNA, 70 bp, Artificial Sequence
  Synthetic
gccaagcatttaggtgacactatagtggggcttgttgttctcagcgtttcagagctatgctggaaacagc

SEQ ID NO: 63192 - DNA, 70 bp, Artificial Sequence
  Synthetic
gccaagcatttaggtgacactatagaacaatgaagccaagtgtctgtttcagagctatgctggaaacagc

SEQ ID NO: 63193 - DNA, 70 bp, Artificial Sequence
  Synthetic
gccaagcatttaggtgacactatagccacgacctctcggttctctgtttcagagctatgctggaaacagc

SEQ ID NO: 63194 - DNA, 70 bp, Artificial Sequence
  Synthetic
gccaagcatttaggtgacactatagttggcaatattcaacgcatagtttcagagctatgctggaaacagc

SEQ ID NO: 63195 - DNA, 70 bp, Artificial Sequence
  Synthetic
gccaagcatttaggtgacactatagcgcatgagaagacactgcttgtttcagagctatgctggaaacagc

SEQ ID NO: 63196 - DNA, 70 bp, Artificial Sequence
  Synthetic
gccaagcatttaggtgacactatagacgctgggattcagactagagtttcagagctatgctggaaacagc

SEQ ID NO: 63197 - DNA, 70 bp, Artificial Sequence
  Synthetic
gccaagcatttaggtgacactataggacccctagagtgctgctgtgtttcagagctatgctggaaacagc

SEQ ID NO: 63198 - DNA, 70 bp, Artificial Sequence
  Synthetic
gccaagcatttaggtgacactatagttctctcttgcctgggctacgtttcagagctatgctggaaacagc

SEQ ID NO: 63199 - DNA, 70 bp, Artificial Sequence
  Synthetic
gccaagcatttaggtgacactatagttgtctttttctttccgtgtgtttcagagctatgctggaaacagc

SEQ ID NO: 63200 - DNA, 70 bp, Artificial Sequence
  Synthetic
gccaagcatttaggtgacactatagcaaagaggaaactcagacaggtttcagagctatgctggaaacagc

SEQ ID NO: 63201 - DNA, 70 bp, Artificial Sequence
  Synthetic
gccaagcatttaggtgacactatagcgcctcccagctcgtggggagtttcagagctatgctggaaacagc

SEQ ID NO: 63202 - DNA, 70 bp, Artificial Sequence
  Synthetic
gccaagcatttaggtgacactatagtctcaaaacccattggcttcgtttcagagctatgctggaaacagc

SEQ ID NO: 63203 - DNA, 70 bp, Artificial Sequence
  Synthetic
gccaagcatttaggtgacactatagtgtctgatgtgtggatcctggtttcagagctatgctggaaacagc

SEQ ID NO: 63204 - DNA, 70 bp, Artificial Sequence
  Synthetic
gccaagcatttaggtgacactatagcatttagaagtcagcatccagtttcagagctatgctggaaacagc

SEQ ID NO: 63205 - DNA, 70 bp, Artificial Sequence
  Synthetic
gccaagcatttaggtgacactatagcacagataacgtcttcacctgtttcagagctatgctggaaacagc

SEQ ID NO: 63206 - DNA, 70 bp, Artificial Sequence
  Synthetic
gccaagcatttaggtgacactatagtcacaaatttctgccgtcaggtttcagagctatgctggaaacagc

SEQ ID NO: 63207 - DNA, 70 bp, Artificial Sequence
  Synthetic
gccaagcatttaggtgacactataggggtcaggctctttctgttcgtttcagagctatgctggaaacagc

SEQ ID NO: 63208 - DNA, 70 bp, Artificial Sequence
  Synthetic
gccaagcatttaggtgacactatagagatgggcaggagctcagcagtttcagagctatgctggaaacagc

SEQ ID NO: 63209 - DNA, 70 bp, Artificial Sequence
  Synthetic
gccaagcatttaggtgacactatagaagaaacgcagggagtgatggtttcagagctatgctggaaacagc

SEQ ID NO: 63210 - DNA, 70 bp, Artificial Sequence
  Synthetic
gccaagcatttaggtgacactatagagaaaggatcgtcgaccctggtttcagagctatgctggaaacagc

SEQ ID NO: 63211 - DNA, 70 bp, Artificial Sequence
  Synthetic
gccaagcatttaggtgacactatagtcagagtcacttgcagattcgtttcagagctatgctggaaacagc

SEQ ID NO: 63212 - DNA, 70 bp, Artificial Sequence
  Synthetic
gccaagcatttaggtgacactatagagggctatggatttcttctggtttcagagctatgctggaaacagc

SEQ ID NO: 63213 - DNA, 70 bp, Artificial Sequence
  Synthetic
gccaagcatttaggtgacactataggacgaaatgcaggcaaggacgtttcagagctatgctggaaacagc

SEQ ID NO: 63214 - DNA, 70 bp, Artificial Sequence
  Synthetic
gccaagcatttaggtgacactataggcggctctcacagctcagtagtttcagagctatgctggaaacagc

SEQ ID NO: 63215 - DNA, 70 bp, Artificial Sequence
  Synthetic
gccaagcatttaggtgacactatagagccatgtctctacaagcgcgtttcagagctatgctggaaacagc

SEQ ID NO: 63216 - DNA, 70 bp, Artificial Sequence
  Synthetic
gccaagcatttaggtgacactataggagtgtcaggaaccagcagcgtttcagagctatgctggaaacagc

SEQ ID NO: 63217 - DNA, 70 bp, Artificial Sequence
  Synthetic
gccaagcatttaggtgacactatagagcgcccaggaggaaagagggtttcagagctatgctggaaacagc

SEQ ID NO: 63218 - DNA, 70 bp, Artificial Sequence
  Synthetic
gccaagcatttaggtgacactatagtgccatccggatggagctgcgtttcagagctatgctggaaacagc

SEQ ID NO: 63219 - DNA, 70 bp, Artificial Sequence
  Synthetic
gccaagcatttaggtgacactataggaacatttttgtcatcctccgtttcagagctatgctggaaacagc

SEQ ID NO: 63220 - DNA, 70 bp, Artificial Sequence
  Synthetic
gccaagcatttaggtgacactatagctgaagctggattggtagaggtttcagagctatgctggaaacagc

SEQ ID NO: 63221 - DNA, 70 bp, Artificial Sequence
  Synthetic
gccaagcatttaggtgacactatagatgtacatatcacacagaaggtttcagagctatgctggaaacagc

SEQ ID NO: 63222 - DNA, 70 bp, Artificial Sequence
  Synthetic
gccaagcatttaggtgacactatagtcaactagacttagatttccgtttcagagctatgctggaaacagc

SEQ ID NO: 63223 - DNA, 70 bp, Artificial Sequence
  Synthetic
gccaagcatttaggtgacactatagccactttcccacagtcatgtgtttcagagctatgctggaaacagc

SEQ ID NO: 63224 - DNA, 70 bp, Artificial Sequence
  Synthetic
gccaagcatttaggtgacactatagggcaggagcaccagaagagggtttcagagctatgctggaaacagc

SEQ ID NO: 63225 - DNA, 70 bp, Artificial Sequence
  Synthetic
gccaagcatttaggtgacactatagcaaccactcgtgactcattcgtttcagagctatgctggaaacagc

SEQ ID NO: 63226 - DNA, 70 bp, Artificial Sequence
  Synthetic
gccaagcatttaggtgacactatagatcactgactttaggtcgacgtttcagagctatgctggaaacagc

SEQ ID NO: 63227 - DNA, 70 bp, Artificial Sequence
  Synthetic
gccaagcatttaggtgacactataggttacaagaggatgtggacagtttcagagctatgctggaaacagc

SEQ ID NO: 63228 - DNA, 70 bp, Artificial Sequence
  Synthetic
gccaagcatttaggtgacactatagggctcacttcatcttagtccgtttcagagctatgctggaaacagc

SEQ ID NO: 63229 - DNA, 70 bp, Artificial Sequence
  Synthetic
gccaagcatttaggtgacactatagtttcttcttcttgctggtgagtttcagagctatgctggaaacagc

SEQ ID NO: 63230 - DNA, 70 bp, Artificial Sequence
  Synthetic
gccaagcatttaggtgacactatagtttgaactcgatgacactgagtttcagagctatgctggaaacagc

SEQ ID NO: 63231 - DNA, 70 bp, Artificial Sequence
  Synthetic
gccaagcatttaggtgacactataggaggaagaattgtcataggagtttcagagctatgctggaaacagc

SEQ ID NO: 63232 - DNA, 70 bp, Artificial Sequence
  Synthetic
gccaagcatttaggtgacactatagatctgaggaagatgaagatggtttcagagctatgctggaaacagc

SEQ ID NO: 63233 - DNA, 70 bp, Artificial Sequence
  Synthetic
gccaagcatttaggtgacactatagggagcatatgccttctccaagtttcagagctatgctggaaacagc

SEQ ID NO: 63234 - DNA, 70 bp, Artificial Sequence
  Synthetic
gccaagcatttaggtgacactatagggcgaggagacagatgactggtttcagagctatgctggaaacagc

SEQ ID NO: 63235 - DNA, 70 bp, Artificial Sequence
  Synthetic
gccaagcatttaggtgacactatagctgtttaaaaacatccaggcgtttcagagctatgctggaaacagc

SEQ ID NO: 63236 - DNA, 70 bp, Artificial Sequence
  Synthetic
gccaagcatttaggtgacactatagttgcccttcatgctatagaagtttcagagctatgctggaaacagc

SEQ ID NO: 63237 - DNA, 70 bp, Artificial Sequence
  Synthetic
gccaagcatttaggtgacactataggctggacagtgtccctaggcgtttcagagctatgctggaaacagc

SEQ ID NO: 63238 - DNA, 70 bp, Artificial Sequence
  Synthetic
gccaagcatttaggtgacactatagtaccggatctcttgttttatgtttcagagctatgctggaaacagc

SEQ ID NO: 63239 - DNA, 70 bp, Artificial Sequence
  Synthetic
gccaagcatttaggtgacactatagagtcagcactgtacactagagtttcagagctatgctggaaacagc

SEQ ID NO: 63240 - DNA, 70 bp, Artificial Sequence
  Synthetic
gccaagcatttaggtgacactataggagccggcggtcagggctgcgtttcagagctatgctggaaacagc

SEQ ID NO: 63241 - DNA, 70 bp, Artificial Sequence
  Synthetic
gccaagcatttaggtgacactatagtggacacactggcagtaatagtttcagagctatgctggaaacagc

SEQ ID NO: 63242 - DNA, 70 bp, Artificial Sequence
  Synthetic
gccaagcatttaggtgacactatagttctttacgacacaatgggcgtttcagagctatgctggaaacagc

SEQ ID NO: 63243 - DNA, 70 bp, Artificial Sequence
  Synthetic
gccaagcatttaggtgacactatagatgtatattacttaggccacgtttcagagctatgctggaaacagc

SEQ ID NO: 63244 - DNA, 70 bp, Artificial Sequence
  Synthetic
gccaagcatttaggtgacactatagcacatcttcaatgcgaggaagtttcagagctatgctggaaacagc

SEQ ID NO: 63245 - DNA, 70 bp, Artificial Sequence
  Synthetic
gccaagcatttaggtgacactatagaaaaaagtccatatggactggtttcagagctatgctggaaacagc

SEQ ID NO: 63246 - DNA, 70 bp, Artificial Sequence
  Synthetic
gccaagcatttaggtgacactatagctggcagccaagaacagatagtttcagagctatgctggaaacagc

SEQ ID NO: 63247 - DNA, 70 bp, Artificial Sequence
  Synthetic
gccaagcatttaggtgacactatagcagggccacgcgtccgctaggtttcagagctatgctggaaacagc

SEQ ID NO: 63248 - DNA, 70 bp, Artificial Sequence
  Synthetic
gccaagcatttaggtgacactataggtaggaggttgggctagggagtttcagagctatgctggaaacagc

SEQ ID NO: 63249 - DNA, 70 bp, Artificial Sequence
  Synthetic
gccaagcatttaggtgacactataggatttgtcatcccaattcctgtttcagagctatgctggaaacagc

SEQ ID NO: 63250 - DNA, 70 bp, Artificial Sequence
  Synthetic
gccaagcatttaggtgacactatagagaccaattgctgtgatcaagtttcagagctatgctggaaacagc

SEQ ID NO: 63251 - DNA, 70 bp, Artificial Sequence
  Synthetic
gccaagcatttaggtgacactataggcaggctgggcacatcctaggtttcagagctatgctggaaacagc

SEQ ID NO: 63252 - DNA, 70 bp, Artificial Sequence
  Synthetic
gccaagcatttaggtgacactataggggcctccgtgggcactcacgtttcagagctatgctggaaacagc

SEQ ID NO: 63253 - DNA, 70 bp, Artificial Sequence
  Synthetic
gccaagcatttaggtgacactatagaagactacaaaaaacgacgagtttcagagctatgctggaaacagc

SEQ ID NO: 63254 - DNA, 70 bp, Artificial Sequence
  Synthetic
gccaagcatttaggtgacactataggtgcgggcttcagaagcagtgtttcagagctatgctggaaacagc

SEQ ID NO: 63255 - DNA, 70 bp, Artificial Sequence
  Synthetic
gccaagcatttaggtgacactatagtgtgcttttgggagccaagtgtttcagagctatgctggaaacagc

SEQ ID NO: 63256 - DNA, 70 bp, Artificial Sequence
  Synthetic
gccaagcatttaggtgacactatagagcacctttctctctcacacgtttcagagctatgctggaaacagc

SEQ ID NO: 63257 - DNA, 70 bp, Artificial Sequence
  Synthetic
gccaagcatttaggtgacactatagggaccctagatcatggctgcgtttcagagctatgctggaaacagc

SEQ ID NO: 63258 - DNA, 70 bp, Artificial Sequence
  Synthetic
gccaagcatttaggtgacactatagtgatactgatgtggtgaatggtttcagagctatgctggaaacagc

SEQ ID NO: 63259 - DNA, 70 bp, Artificial Sequence
  Synthetic
gccaagcatttaggtgacactatagcagggaggcgtcttcagtcggtttcagagctatgctggaaacagc

SEQ ID NO: 63260 - DNA, 70 bp, Artificial Sequence
  Synthetic
gccaagcatttaggtgacactatagctgggctgtgttcagaacccgtttcagagctatgctggaaacagc

SEQ ID NO: 63261 - DNA, 70 bp, Artificial Sequence
  Synthetic
gccaagcatttaggtgacactatagatccaggcctgccagtaagggtttcagagctatgctggaaacagc

SEQ ID NO: 63262 - DNA, 70 bp, Artificial Sequence
  Synthetic
gccaagcatttaggtgacactatagctttcctggtctcctcttacgtttcagagctatgctggaaacagc

SEQ ID NO: 63263 - DNA, 70 bp, Artificial Sequence
  Synthetic
gccaagcatttaggtgacactatagccagcactcaaactcgaattgtttcagagctatgctggaaacagc

SEQ ID NO: 63264 - DNA, 70 bp, Artificial Sequence
  Synthetic
gccaagcatttaggtgacactatagattcttaaagattccgtgctgtttcagagctatgctggaaacagc

SEQ ID NO: 63265 - DNA, 70 bp, Artificial Sequence
  Synthetic
gccaagcatttaggtgacactatagcttaagccctggcagctatggtttcagagctatgctggaaacagc

SEQ ID NO: 63266 - DNA, 70 bp, Artificial Sequence
  Synthetic
gccaagcatttaggtgacactatagcgcatctcaccaacagactggtttcagagctatgctggaaacagc

SEQ ID NO: 63267 - DNA, 70 bp, Artificial Sequence
  Synthetic
gccaagcatttaggtgacactataggaggacgaggacttctaggcgtttcagagctatgctggaaacagc

SEQ ID NO: 63268 - DNA, 70 bp, Artificial Sequence
  Synthetic
gccaagcatttaggtgacactatagaacctcttgtgttcttgcctgtttcagagctatgctggaaacagc

SEQ ID NO: 63269 - DNA, 70 bp, Artificial Sequence
  Synthetic
gccaagcatttaggtgacactatagttccatggagttttacttgtgtttcagagctatgctggaaacagc

SEQ ID NO: 63270 - DNA, 70 bp, Artificial Sequence
  Synthetic
gccaagcatttaggtgacactatagctaaaatcccaggcgctaaggtttcagagctatgctggaaacagc

SEQ ID NO: 63271 - DNA, 70 bp, Artificial Sequence
  Synthetic
gccaagcatttaggtgacactataggcagagacaccgttctcattgtttcagagctatgctggaaacagc

SEQ ID NO: 63272 - DNA, 70 bp, Artificial Sequence
  Synthetic
gccaagcatttaggtgacactatagccctggaatcgccaaaaaaagtttcagagctatgctggaaacagc

SEQ ID NO: 63273 - DNA, 70 bp, Artificial Sequence
  Synthetic
gccaagcatttaggtgacactatagcgtcgttacttgtactatgagtttcagagctatgctggaaacagc

SEQ ID NO: 63274 - DNA, 70 bp, Artificial Sequence
  Synthetic
gccaagcatttaggtgacactatagtgcttgatactgagggttaagtttcagagctatgctggaaacagc

SEQ ID NO: 63275 - DNA, 70 bp, Artificial Sequence
  Synthetic
gccaagcatttaggtgacactatagtcagctttgcgcttcaatccgtttcagagctatgctggaaacagc

SEQ ID NO: 63276 - DNA, 70 bp, Artificial Sequence
  Synthetic
gccaagcatttaggtgacactataggtggaaagaggacacgcacggtttcagagctatgctggaaacagc

SEQ ID NO: 63277 - DNA, 70 bp, Artificial Sequence
  Synthetic
gccaagcatttaggtgacactatagtgtgtccgctgggggtcagcgtttcagagctatgctggaaacagc

SEQ ID NO: 63278 - DNA, 70 bp, Artificial Sequence
  Synthetic
gccaagcatttaggtgacactatagctgacgccctgggtcctcaggtttcagagctatgctggaaacagc

SEQ ID NO: 63279 - DNA, 70 bp, Artificial Sequence
  Synthetic
gccaagcatttaggtgacactataggatctcagcaccgcagtcaggtttcagagctatgctggaaacagc

SEQ ID NO: 63280 - DNA, 70 bp, Artificial Sequence
  Synthetic
gccaagcatttaggtgacactatagcccaaccacggaatcttatagtttcagagctatgctggaaacagc

SEQ ID NO: 63281 - DNA, 70 bp, Artificial Sequence
  Synthetic
gccaagcatttaggtgacactatagtcagtcctgccttcttttaggtttcagagctatgctggaaacagc

SEQ ID NO: 63282 - DNA, 70 bp, Artificial Sequence
  Synthetic
gccaagcatttaggtgacactatagtgtcattctcattgttatcggtttcagagctatgctggaaacagc

SEQ ID NO: 63283 - DNA, 70 bp, Artificial Sequence
  Synthetic
gccaagcatttaggtgacactatagataaagacacagatgttcaggtttcagagctatgctggaaacagc

SEQ ID NO: 63284 - DNA, 70 bp, Artificial Sequence
  Synthetic
gccaagcatttaggtgacactatagtcggggcgtcacacttgctggtttcagagctatgctggaaacagc

SEQ ID NO: 63285 - DNA, 70 bp, Artificial Sequence
  Synthetic
gccaagcatttaggtgacactatagatggcactcaggaagaattagtttcagagctatgctggaaacagc

SEQ ID NO: 63286 - DNA, 70 bp, Artificial Sequence
  Synthetic
gccaagcatttaggtgacactatagctgcacgtgctttcttcagggtttcagagctatgctggaaacagc

SEQ ID NO: 63287 - DNA, 70 bp, Artificial Sequence
  Synthetic
gccaagcatttaggtgacactatagggggcatcatgttgctgcaggtttcagagctatgctggaaacagc

SEQ ID NO: 63288 - DNA, 70 bp, Artificial Sequence
  Synthetic
gccaagcatttaggtgacactatagcagtctttttcacagtactcgtttcagagctatgctggaaacagc

SEQ ID NO: 63289 - DNA, 70 bp, Artificial Sequence
  Synthetic
gccaagcatttaggtgacactatagcctgaggacggacgttcagggtttcagagctatgctggaaacagc

SEQ ID NO: 63290 - DNA, 70 bp, Artificial Sequence
  Synthetic
gccaagcatttaggtgacactatagcacgcaggaccagtacaagcgtttcagagctatgctggaaacagc

SEQ ID NO: 63291 - DNA, 70 bp, Artificial Sequence
  Synthetic
gccaagcatttaggtgacactatagctgaatgagcagtgcatgacgtttcagagctatgctggaaacagc

SEQ ID NO: 63292 - DNA, 70 bp, Artificial Sequence
  Synthetic
gccaagcatttaggtgacactatagggaagagaagactaatcagagtttcagagctatgctggaaacagc

SEQ ID NO: 63293 - DNA, 70 bp, Artificial Sequence
  Synthetic
gccaagcatttaggtgacactatagactgatcccaaaacatcattgtttcagagctatgctggaaacagc

SEQ ID NO: 63294 - DNA, 70 bp, Artificial Sequence
  Synthetic
gccaagcatttaggtgacactatagcttggcctccagtcttatgagtttcagagctatgctggaaacagc

SEQ ID NO: 63295 - DNA, 70 bp, Artificial Sequence
  Synthetic
gccaagcatttaggtgacactatagttggtcttggtcaggtgaccgtttcagagctatgctggaaacagc

SEQ ID NO: 63296 - DNA, 70 bp, Artificial Sequence
  Synthetic
gccaagcatttaggtgacactataggttagggcactctcatcaaagtttcagagctatgctggaaacagc

SEQ ID NO: 63297 - DNA, 70 bp, Artificial Sequence
  Synthetic
gccaagcatttaggtgacactataggaagctcagagccaaattaggtttcagagctatgctggaaacagc

SEQ ID NO: 63298 - DNA, 70 bp, Artificial Sequence
  Synthetic
gccaagcatttaggtgacactatagtgcccatgctgttcctcagcgtttcagagctatgctggaaacagc

SEQ ID NO: 63299 - DNA, 70 bp, Artificial Sequence
  Synthetic
gccaagcatttaggtgacactatagtttcaggatggagttaggccgtttcagagctatgctggaaacagc

SEQ ID NO: 63300 - DNA, 70 bp, Artificial Sequence
  Synthetic
gccaagcatttaggtgacactatagacagcaccctggagatgttagtttcagagctatgctggaaacagc

SEQ ID NO: 63301 - DNA, 70 bp, Artificial Sequence
  Synthetic
gccaagcatttaggtgacactataggccaggcctggcgcctcagtgtttcagagctatgctggaaacagc

SEQ ID NO: 63302 - DNA, 70 bp, Artificial Sequence
  Synthetic
gccaagcatttaggtgacactatagttctgagttcacgtctagcggtttcagagctatgctggaaacagc

SEQ ID NO: 63303 - DNA, 70 bp, Artificial Sequence
  Synthetic
gccaagcatttaggtgacactatagactgctgaggaatttcaatagtttcagagctatgctggaaacagc

SEQ ID NO: 63304 - DNA, 70 bp, Artificial Sequence
  Synthetic
gccaagcatttaggtgacactatagagtccaccagggcggtcagtgtttcagagctatgctggaaacagc

SEQ ID NO: 63305 - DNA, 70 bp, Artificial Sequence
  Synthetic
gccaagcatttaggtgacactatagggtcccagggctacagaacagtttcagagctatgctggaaacagc

SEQ ID NO: 63306 - DNA, 70 bp, Artificial Sequence
  Synthetic
gccaagcatttaggtgacactatagcctggaagcagccaaaactggtttcagagctatgctggaaacagc

SEQ ID NO: 63307 - DNA, 70 bp, Artificial Sequence
  Synthetic
gccaagcatttaggtgacactatagaagcatgttcattgagtcatgtttcagagctatgctggaaacagc

SEQ ID NO: 63308 - DNA, 70 bp, Artificial Sequence
  Synthetic
gccaagcatttaggtgacactatagacttcatgtacttatcctgcgtttcagagctatgctggaaacagc

SEQ ID NO: 63309 - DNA, 70 bp, Artificial Sequence
  Synthetic
gccaagcatttaggtgacactatagattttagcaagcaagttggcgtttcagagctatgctggaaacagc

SEQ ID NO: 63310 - DNA, 70 bp, Artificial Sequence
  Synthetic
gccaagcatttaggtgacactatagaccatggacacctcctgagtgtttcagagctatgctggaaacagc

SEQ ID NO: 63311 - DNA, 70 bp, Artificial Sequence
  Synthetic
gccaagcatttaggtgacactatagagagtgactcagctgactaagtttcagagctatgctggaaacagc

SEQ ID NO: 63312 - DNA, 70 bp, Artificial Sequence
  Synthetic
gccaagcatttaggtgacactatagctcatggtgactatggattagtttcagagctatgctggaaacagc

SEQ ID NO: 63313 - DNA, 70 bp, Artificial Sequence
  Synthetic
gccaagcatttaggtgacactatagcagatgttctttggtgtagagtttcagagctatgctggaaacagc

SEQ ID NO: 63314 - DNA, 70 bp, Artificial Sequence
  Synthetic
gccaagcatttaggtgacactatagaaagtagatgtggactcaaggtttcagagctatgctggaaacagc

SEQ ID NO: 63315 - DNA, 70 bp, Artificial Sequence
  Synthetic
gccaagcatttaggtgacactatagctccgaatttgtacttgctcgtttcagagctatgctggaaacagc

SEQ ID NO: 63316 - DNA, 70 bp, Artificial Sequence
  Synthetic
gccaagcatttaggtgacactatagtttaactttttggcaccttggtttcagagctatgctggaaacagc

SEQ ID NO: 63317 - DNA, 70 bp, Artificial Sequence
  Synthetic
gccaagcatttaggtgacactatagtttaagcaaaactggctctagtttcagagctatgctggaaacagc

SEQ ID NO: 63318 - DNA, 70 bp, Artificial Sequence
  Synthetic
gccaagcatttaggtgacactatagtttcagagtcagtcatgaatgtttcagagctatgctggaaacagc

SEQ ID NO: 63319 - DNA, 70 bp, Artificial Sequence
  Synthetic
gccaagcatttaggtgacactatagctcctcttccctgaaacttggtttcagagctatgctggaaacagc

SEQ ID NO: 63320 - DNA, 70 bp, Artificial Sequence
  Synthetic
gccaagcatttaggtgacactatagggcctgaggcctgcgtcagtgtttcagagctatgctggaaacagc

SEQ ID NO: 63321 - DNA, 70 bp, Artificial Sequence
  Synthetic
gccaagcatttaggtgacactatagacctggacagagggacacccgtttcagagctatgctggaaacagc

SEQ ID NO: 63322 - DNA, 70 bp, Artificial Sequence
  Synthetic
gccaagcatttaggtgacactatagggcgccgcaccaaatgacttgtttcagagctatgctggaaacagc

SEQ ID NO: 63323 - DNA, 70 bp, Artificial Sequence
  Synthetic
gccaagcatttaggtgacactatagtctgagctcaggccagttgagtttcagagctatgctggaaacagc

SEQ ID NO: 63324 - DNA, 70 bp, Artificial Sequence
  Synthetic
gccaagcatttaggtgacactatagggggctcaggtgatctgcaggtttcagagctatgctggaaacagc

SEQ ID NO: 63325 - DNA, 70 bp, Artificial Sequence
  Synthetic
gccaagcatttaggtgacactatagactgctgacatgtcgcccttgtttcagagctatgctggaaacagc

SEQ ID NO: 63326 - DNA, 70 bp, Artificial Sequence
  Synthetic
gccaagcatttaggtgacactatagattggagaggagtcagacgtgtttcagagctatgctggaaacagc

SEQ ID NO: 63327 - DNA, 70 bp, Artificial Sequence
  Synthetic
gccaagcatttaggtgacactatagtgggggtgtgtcagctaagcgtttcagagctatgctggaaacagc

SEQ ID NO: 63328 - DNA, 70 bp, Artificial Sequence
  Synthetic
gccaagcatttaggtgacactataggggtctgagtttaatttagcgtttcagagctatgctggaaacagc

SEQ ID NO: 63329 - DNA, 70 bp, Artificial Sequence
  Synthetic
gccaagcatttaggtgacactatagttgtttacgaaagcagtcacgtttcagagctatgctggaaacagc

SEQ ID NO: 63330 - DNA, 70 bp, Artificial Sequence
  Synthetic
gccaagcatttaggtgacactatagggcctgtaacaatttcttctgtttcagagctatgctggaaacagc

SEQ ID NO: 63331 - DNA, 70 bp, Artificial Sequence
  Synthetic
gccaagcatttaggtgacactataggaagcagaagggaaagaagtgtttcagagctatgctggaaacagc

SEQ ID NO: 63332 - DNA, 70 bp, Artificial Sequence
  Synthetic
gccaagcatttaggtgacactatagccttcccagaagcggacctggtttcagagctatgctggaaacagc

SEQ ID NO: 63333 - DNA, 70 bp, Artificial Sequence
  Synthetic
gccaagcatttaggtgacactatagttaccacacccacaaagagtgtttcagagctatgctggaaacagc

SEQ ID NO: 63334 - DNA, 70 bp, Artificial Sequence
  Synthetic
gccaagcatttaggtgacactatagagaagaaagacctgaagatcgtttcagagctatgctggaaacagc

SEQ ID NO: 63335 - DNA, 70 bp, Artificial Sequence
  Synthetic
gccaagcatttaggtgacactataggagggagttctcagtgccccgtttcagagctatgctggaaacagc

SEQ ID NO: 63336 - DNA, 70 bp, Artificial Sequence
  Synthetic
gccaagcatttaggtgacactatagtgctctgctgctcctgctcagtttcagagctatgctggaaacagc

SEQ ID NO: 63337 - DNA, 70 bp, Artificial Sequence
  Synthetic
gccaagcatttaggtgacactatagcaagagttctgcttcagggtgtttcagagctatgctggaaacagc

SEQ ID NO: 63338 - DNA, 70 bp, Artificial Sequence
  Synthetic
gccaagcatttaggtgacactatagccccctggagcagaggctacgtttcagagctatgctggaaacagc

SEQ ID NO: 63339 - DNA, 70 bp, Artificial Sequence
  Synthetic
gccaagcatttaggtgacactataggaggagttttcatttcttccgtttcagagctatgctggaaacagc

SEQ ID NO: 63340 - DNA, 70 bp, Artificial Sequence
  Synthetic
gccaagcatttaggtgacactatagctagaggacaacaagtgaccgtttcagagctatgctggaaacagc

SEQ ID NO: 63341 - DNA, 70 bp, Artificial Sequence
  Synthetic
gccaagcatttaggtgacactatagatctacaatgaagccctcaagtttcagagctatgctggaaacagc

SEQ ID NO: 63342 - DNA, 70 bp, Artificial Sequence
  Synthetic
gccaagcatttaggtgacactatagcattggtggggctgggtcacgtttcagagctatgctggaaacagc

SEQ ID NO: 63343 - DNA, 70 bp, Artificial Sequence
  Synthetic
gccaagcatttaggtgacactataggtgaccctgtggaagtgagagtttcagagctatgctggaaacagc

SEQ ID NO: 63344 - DNA, 70 bp, Artificial Sequence
  Synthetic
gccaagcatttaggtgacactatagcctgggtagggtgggatcacgtttcagagctatgctggaaacagc

SEQ ID NO: 63345 - DNA, 70 bp, Artificial Sequence
  Synthetic
gccaagcatttaggtgacactatagagtaactcagctactctttggtttcagagctatgctggaaacagc

SEQ ID NO: 63346 - DNA, 70 bp, Artificial Sequence
  Synthetic
gccaagcatttaggtgacactatagcttggccactgtggtcttaggtttcagagctatgctggaaacagc

SEQ ID NO: 63347 - DNA, 70 bp, Artificial Sequence
  Synthetic
gccaagcatttaggtgacactatagactcatgttcaaagaactcggtttcagagctatgctggaaacagc

SEQ ID NO: 63348 - DNA, 70 bp, Artificial Sequence
  Synthetic
gccaagcatttaggtgacactataggaactggacaagaatggagagtttcagagctatgctggaaacagc

SEQ ID NO: 63349 - DNA, 70 bp, Artificial Sequence
  Synthetic
gccaagcatttaggtgacactatagcacaagtactttgagaaggcgtttcagagctatgctggaaacagc

SEQ ID NO: 63350 - DNA, 70 bp, Artificial Sequence
  Synthetic
gccaagcatttaggtgacactatagaattaactgtacgagaagtcgtttcagagctatgctggaaacagc

SEQ ID NO: 63351 - DNA, 70 bp, Artificial Sequence
  Synthetic
gccaagcatttaggtgacactatagtaatgaattcgtggtcatgggtttcagagctatgctggaaacagc

SEQ ID NO: 63352 - DNA, 70 bp, Artificial Sequence
  Synthetic
gccaagcatttaggtgacactatagccagagaccattatgtcttcgtttcagagctatgctggaaacagc

SEQ ID NO: 63353 - DNA, 70 bp, Artificial Sequence
  Synthetic
gccaagcatttaggtgacactatagagggcaacacggtggtctgagtttcagagctatgctggaaacagc

SEQ ID NO: 63354 - DNA, 70 bp, Artificial Sequence
  Synthetic
gccaagcatttaggtgacactatagagaacgcagcacttcagaatgtttcagagctatgctggaaacagc

SEQ ID NO: 63355 - DNA, 70 bp, Artificial Sequence
  Synthetic
gccaagcatttaggtgacactatagacttcagatgctccgcacgcgtttcagagctatgctggaaacagc

SEQ ID NO: 63356 - DNA, 70 bp, Artificial Sequence
  Synthetic
gccaagcatttaggtgacactatagcgagggtgtcagtctgcagcgtttcagagctatgctggaaacagc

SEQ ID NO: 63357 - DNA, 70 bp, Artificial Sequence
  Synthetic
gccaagcatttaggtgacactataggaggaagctcagtatttctcgtttcagagctatgctggaaacagc

SEQ ID NO: 63358 - DNA, 70 bp, Artificial Sequence
  Synthetic
gccaagcatttaggtgacactatagaaggggacctgggggtgcctgtttcagagctatgctggaaacagc

SEQ ID NO: 63359 - DNA, 70 bp, Artificial Sequence
  Synthetic
gccaagcatttaggtgacactatagcaggaagctcagtatttcttgtttcagagctatgctggaaacagc

SEQ ID NO: 63360 - DNA, 70 bp, Artificial Sequence
  Synthetic
gccaagcatttaggtgacactatagtaagtctgaaccttcaaactgtttcagagctatgctggaaacagc

SEQ ID NO: 63361 - DNA, 70 bp, Artificial Sequence
  Synthetic
gccaagcatttaggtgacactatagcctgggtccccagcctgagggtttcagagctatgctggaaacagc

SEQ ID NO: 63362 - DNA, 70 bp, Artificial Sequence
  Synthetic
gccaagcatttaggtgacactatagcttttctttctggaccagtcgtttcagagctatgctggaaacagc

SEQ ID NO: 63363 - DNA, 70 bp, Artificial Sequence
  Synthetic
gccaagcatttaggtgacactatagtgaggttgctatgagggtgagtttcagagctatgctggaaacagc

SEQ ID NO: 63364 - DNA, 70 bp, Artificial Sequence
  Synthetic
gccaagcatttaggtgacactatagcctgtccccttccttcatgagtttcagagctatgctggaaacagc

SEQ ID NO: 63365 - DNA, 70 bp, Artificial Sequence
  Synthetic
gccaagcatttaggtgacactatagtgccaaatcttgagttcactgtttcagagctatgctggaaacagc

SEQ ID NO: 63366 - DNA, 70 bp, Artificial Sequence
  Synthetic
gccaagcatttaggtgacactatagtttggcacaggaaattgtgagtttcagagctatgctggaaacagc

SEQ ID NO: 63367 - DNA, 70 bp, Artificial Sequence
  Synthetic
gccaagcatttaggtgacactatagggattccaagtactcagtaggtttcagagctatgctggaaacagc

SEQ ID NO: 63368 - DNA, 70 bp, Artificial Sequence
  Synthetic
gccaagcatttaggtgacactatagcagcgagtgggacttagtaggtttcagagctatgctggaaacagc

SEQ ID NO: 63369 - DNA, 70 bp, Artificial Sequence
  Synthetic
gccaagcatttaggtgacactatagatgcaggagaagctgaggaggtttcagagctatgctggaaacagc

SEQ ID NO: 63370 - DNA, 70 bp, Artificial Sequence
  Synthetic
gccaagcatttaggtgacactatagtgtgcttaacttttctgagagtttcagagctatgctggaaacagc

SEQ ID NO: 63371 - DNA, 70 bp, Artificial Sequence
  Synthetic
gccaagcatttaggtgacactatagccgcttcgtggaggacagcagtttcagagctatgctggaaacagc

SEQ ID NO: 63372 - DNA, 70 bp, Artificial Sequence
  Synthetic
gccaagcatttaggtgacactataggtacagaaaaacaggctcatgtttcagagctatgctggaaacagc

SEQ ID NO: 63373 - DNA, 70 bp, Artificial Sequence
  Synthetic
gccaagcatttaggtgacactatagttgctacttcttgtctatgagtttcagagctatgctggaaacagc

SEQ ID NO: 63374 - DNA, 70 bp, Artificial Sequence
  Synthetic
gccaagcatttaggtgacactatagatcgaggataacaaggagatgtttcagagctatgctggaaacagc

SEQ ID NO: 63375 - DNA, 70 bp, Artificial Sequence
  Synthetic
gccaagcatttaggtgacactatagacaagattgcggtcagctaagtttcagagctatgctggaaacagc

SEQ ID NO: 63376 - DNA, 70 bp, Artificial Sequence
  Synthetic
gccaagcatttaggtgacactataggatgaccccgatggcttcttgtttcagagctatgctggaaacagc

SEQ ID NO: 63377 - DNA, 70 bp, Artificial Sequence
  Synthetic
gccaagcatttaggtgacactatagcagctaggacattttcccgagtttcagagctatgctggaaacagc

SEQ ID NO: 63378 - DNA, 70 bp, Artificial Sequence
  Synthetic
gccaagcatttaggtgacactatagccttcccagcctctgtgttggtttcagagctatgctggaaacagc

SEQ ID NO: 63379 - DNA, 70 bp, Artificial Sequence
  Synthetic
gccaagcatttaggtgacactatagattaggacagacaggagtcagtttcagagctatgctggaaacagc

SEQ ID NO: 63380 - DNA, 70 bp, Artificial Sequence
  Synthetic
gccaagcatttaggtgacactatagcttcttctcgcaccttcagcgtttcagagctatgctggaaacagc

SEQ ID NO: 63381 - DNA, 70 bp, Artificial Sequence
  Synthetic
gccaagcatttaggtgacactatagtttaaatgctttgtctgcaggtttcagagctatgctggaaacagc

SEQ ID NO: 63382 - DNA, 70 bp, Artificial Sequence
  Synthetic
gccaagcatttaggtgacactatagaggaggccaagaagagctaggtttcagagctatgctggaaacagc

SEQ ID NO: 63383 - DNA, 70 bp, Artificial Sequence
  Synthetic
gccaagcatttaggtgacactatagtaccttgcactgaaccataggtttcagagctatgctggaaacagc

SEQ ID NO: 63384 - DNA, 70 bp, Artificial Sequence
  Synthetic
gccaagcatttaggtgacactatagttggcatgctattaagtgaggtttcagagctatgctggaaacagc

SEQ ID NO: 63385 - DNA, 70 bp, Artificial Sequence
  Synthetic
gccaagcatttaggtgacactatagtctcgtcttcagcttctagagtttcagagctatgctggaaacagc

SEQ ID NO: 63386 - DNA, 70 bp, Artificial Sequence
  Synthetic
gccaagcatttaggtgacactatagcaaaacctccaccatctgacgtttcagagctatgctggaaacagc

SEQ ID NO: 63387 - DNA, 70 bp, Artificial Sequence
  Synthetic
gccaagcatttaggtgacactatagccgtcgagggatctctgctggtttcagagctatgctggaaacagc

SEQ ID NO: 63388 - DNA, 70 bp, Artificial Sequence
  Synthetic
gccaagcatttaggtgacactatagtagcggctctgtgatgacttgtttcagagctatgctggaaacagc

SEQ ID NO: 63389 - DNA, 70 bp, Artificial Sequence
  Synthetic
gccaagcatttaggtgacactatagattcctaaaggaattgagcggtttcagagctatgctggaaacagc

SEQ ID NO: 63390 - DNA, 70 bp, Artificial Sequence
  Synthetic
gccaagcatttaggtgacactatagagagtaggagagcaaggattgtttcagagctatgctggaaacagc

SEQ ID NO: 63391 - DNA, 70 bp, Artificial Sequence
  Synthetic
gccaagcatttaggtgacactatagttagtgcttctatgcgtattgtttcagagctatgctggaaacagc

SEQ ID NO: 63392 - DNA, 70 bp, Artificial Sequence
  Synthetic
gccaagcatttaggtgacactatagataagcaagtgggcctccaagtttcagagctatgctggaaacagc

SEQ ID NO: 63393 - DNA, 70 bp, Artificial Sequence
  Synthetic
gccaagcatttaggtgacactatagacttctatatcatatgccaggtttcagagctatgctggaaacagc

SEQ ID NO: 63394 - DNA, 70 bp, Artificial Sequence
  Synthetic
gccaagcatttaggtgacactatagctgactacagacattcacatgtttcagagctatgctggaaacagc

SEQ ID NO: 63395 - DNA, 70 bp, Artificial Sequence
  Synthetic
gccaagcatttaggtgacactatagcctgtaggggtgtcggctacgtttcagagctatgctggaaacagc

SEQ ID NO: 63396 - DNA, 70 bp, Artificial Sequence
  Synthetic
gccaagcatttaggtgacactatagggaatgcgtgttcagtcactgtttcagagctatgctggaaacagc

SEQ ID NO: 63397 - DNA, 70 bp, Artificial Sequence
  Synthetic
gccaagcatttaggtgacactatagagtgtccaaattgaagcgaagtttcagagctatgctggaaacagc

SEQ ID NO: 63398 - DNA, 70 bp, Artificial Sequence
  Synthetic
gccaagcatttaggtgacactatagtatggtctcatgcgccctgagtttcagagctatgctggaaacagc

SEQ ID NO: 63399 - DNA, 70 bp, Artificial Sequence
  Synthetic
gccaagcatttaggtgacactatagcctgagaaggctatggacaagtttcagagctatgctggaaacagc

SEQ ID NO: 63400 - DNA, 70 bp, Artificial Sequence
  Synthetic
gccaagcatttaggtgacactatagggttgatagtggtgttcactgtttcagagctatgctggaaacagc

SEQ ID NO: 63401 - DNA, 70 bp, Artificial Sequence
  Synthetic
gccaagcatttaggtgacactatagtggcccctcaggtcactgctgtttcagagctatgctggaaacagc

SEQ ID NO: 63402 - DNA, 70 bp, Artificial Sequence
  Synthetic
gccaagcatttaggtgacactatagggtggcaagcagcttgagtggtttcagagctatgctggaaacagc

SEQ ID NO: 63403 - DNA, 70 bp, Artificial Sequence
  Synthetic
gccaagcatttaggtgacactataggtgagaggagggtttagacagtttcagagctatgctggaaacagc

SEQ ID NO: 63404 - DNA, 70 bp, Artificial Sequence
  Synthetic
gccaagcatttaggtgacactatagggcccacaaggactagatgagtttcagagctatgctggaaacagc

SEQ ID NO: 63405 - DNA, 70 bp, Artificial Sequence
  Synthetic
gccaagcatttaggtgacactatagcaatatactgggagagccaggtttcagagctatgctggaaacagc

SEQ ID NO: 63406 - DNA, 70 bp, Artificial Sequence
  Synthetic
gccaagcatttaggtgacactatagcaatgtactgtgccatccaggtttcagagctatgctggaaacagc

SEQ ID NO: 63407 - DNA, 70 bp, Artificial Sequence
  Synthetic
gccaagcatttaggtgacactatagctttctactttatcgtctccgtttcagagctatgctggaaacagc

SEQ ID NO: 63408 - DNA, 70 bp, Artificial Sequence
  Synthetic
gccaagcatttaggtgacactataggggtgaagggaatctactgagtttcagagctatgctggaaacagc

SEQ ID NO: 63409 - DNA, 70 bp, Artificial Sequence
  Synthetic
gccaagcatttaggtgacactataggaactggggactggttaggtgtttcagagctatgctggaaacagc

SEQ ID NO: 63410 - DNA, 70 bp, Artificial Sequence
  Synthetic
gccaagcatttaggtgacactatagggaaaagagcagagcgctttgtttcagagctatgctggaaacagc

SEQ ID NO: 63411 - DNA, 70 bp, Artificial Sequence
  Synthetic
gccaagcatttaggtgacactatagaaacaggctgcagaacatgggtttcagagctatgctggaaacagc

SEQ ID NO: 63412 - DNA, 70 bp, Artificial Sequence
  Synthetic
gccaagcatttaggtgacactataggtgggttcttagcttacagcgtttcagagctatgctggaaacagc

SEQ ID NO: 63413 - DNA, 70 bp, Artificial Sequence
  Synthetic
gccaagcatttaggtgacactatagggcgggagggcgctgtcactgtttcagagctatgctggaaacagc

SEQ ID NO: 63414 - DNA, 70 bp, Artificial Sequence
  Synthetic
gccaagcatttaggtgacactatagctgtttctgagaaagtgaacgtttcagagctatgctggaaacagc

SEQ ID NO: 63415 - DNA, 70 bp, Artificial Sequence
  Synthetic
gccaagcatttaggtgacactatagggccctgaggccatgtagccgtttcagagctatgctggaaacagc

SEQ ID NO: 63416 - DNA, 70 bp, Artificial Sequence
  Synthetic
gccaagcatttaggtgacactatagctggccggggcaccttgagggtttcagagctatgctggaaacagc

SEQ ID NO: 63417 - DNA, 70 bp, Artificial Sequence
  Synthetic
gccaagcatttaggtgacactatagtaactgtttggtaactgcccgtttcagagctatgctggaaacagc

SEQ ID NO: 63418 - DNA, 70 bp, Artificial Sequence
  Synthetic
gccaagcatttaggtgacactatagaaaatggcaacagaggagtggtttcagagctatgctggaaacagc

SEQ ID NO: 63419 - DNA, 70 bp, Artificial Sequence
  Synthetic
gccaagcatttaggtgacactataggaggcaacgagaaagttggcgtttcagagctatgctggaaacagc

SEQ ID NO: 63420 - DNA, 70 bp, Artificial Sequence
  Synthetic
gccaagcatttaggtgacactataggaagaagagctgtcagtggagtttcagagctatgctggaaacagc

SEQ ID NO: 63421 - DNA, 70 bp, Artificial Sequence
  Synthetic
gccaagcatttaggtgacactatagtatctctggtcaatttcggcgtttcagagctatgctggaaacagc

SEQ ID NO: 63422 - DNA, 70 bp, Artificial Sequence
  Synthetic
gccaagcatttaggtgacactataggcagttacattgagttgtgagtttcagagctatgctggaaacagc

SEQ ID NO: 63423 - DNA, 70 bp, Artificial Sequence
  Synthetic
gccaagcatttaggtgacactatagcagtggtatgcccaacaacagtttcagagctatgctggaaacagc

SEQ ID NO: 63424 - DNA, 70 bp, Artificial Sequence
  Synthetic
gccaagcatttaggtgacactatagaaaccccaaccagagggagtgtttcagagctatgctggaaacagc

SEQ ID NO: 63425 - DNA, 70 bp, Artificial Sequence
  Synthetic
gccaagcatttaggtgacactatagcaagattattcctgcagtgagtttcagagctatgctggaaacagc

SEQ ID NO: 63426 - DNA, 70 bp, Artificial Sequence
  Synthetic
gccaagcatttaggtgacactataggcttgcatggaacataataggtttcagagctatgctggaaacagc

SEQ ID NO: 63427 - DNA, 70 bp, Artificial Sequence
  Synthetic
gccaagcatttaggtgacactataggagacccctggcagggagatgtttcagagctatgctggaaacagc

SEQ ID NO: 63428 - DNA, 70 bp, Artificial Sequence
  Synthetic
gccaagcatttaggtgacactatagaactaaaggcaaaggttcttgtttcagagctatgctggaaacagc

SEQ ID NO: 63429 - DNA, 70 bp, Artificial Sequence
  Synthetic
gccaagcatttaggtgacactataggggaggctcaggcgtccgacgtttcagagctatgctggaaacagc

SEQ ID NO: 63430 - DNA, 70 bp, Artificial Sequence
  Synthetic
gccaagcatttaggtgacactatagaggcatcagagatacaactcgtttcagagctatgctggaaacagc

SEQ ID NO: 63431 - DNA, 70 bp, Artificial Sequence
  Synthetic
gccaagcatttaggtgacactataggactcagacgcagatctcgagtttcagagctatgctggaaacagc

SEQ ID NO: 63432 - DNA, 70 bp, Artificial Sequence
  Synthetic
gccaagcatttaggtgacactataggagcggtggaagaggaggctgtttcagagctatgctggaaacagc

SEQ ID NO: 63433 - DNA, 70 bp, Artificial Sequence
  Synthetic
gccaagcatttaggtgacactataggatgggggagctccctgaccgtttcagagctatgctggaaacagc

SEQ ID NO: 63434 - DNA, 70 bp, Artificial Sequence
  Synthetic
gccaagcatttaggtgacactatagtcttcatgcgttgctcaagtgtttcagagctatgctggaaacagc

SEQ ID NO: 63435 - DNA, 70 bp, Artificial Sequence
  Synthetic
gccaagcatttaggtgacactatagcgcctaaaggcgtgtcagaggtttcagagctatgctggaaacagc

SEQ ID NO: 63436 - DNA, 70 bp, Artificial Sequence
  Synthetic
gccaagcatttaggtgacactataggccaacatcatgccctaaacgtttcagagctatgctggaaacagc

SEQ ID NO: 63437 - DNA, 70 bp, Artificial Sequence
  Synthetic
gccaagcatttaggtgacactataggaacagctggacaagaacacgtttcagagctatgctggaaacagc

SEQ ID NO: 63438 - DNA, 70 bp, Artificial Sequence
  Synthetic
gccaagcatttaggtgacactatagcgcagcagccattcaggaaagtttcagagctatgctggaaacagc

SEQ ID NO: 63439 - DNA, 70 bp, Artificial Sequence
  Synthetic
gccaagcatttaggtgacactataggctggccagggctctcagaggtttcagagctatgctggaaacagc

SEQ ID NO: 63440 - DNA, 70 bp, Artificial Sequence
  Synthetic
gccaagcatttaggtgacactatagggggagccaaaagaaaactcgtttcagagctatgctggaaacagc

SEQ ID NO: 63441 - DNA, 70 bp, Artificial Sequence
  Synthetic
gccaagcatttaggtgacactatagacaaattccagtctctaacggtttcagagctatgctggaaacagc

SEQ ID NO: 63442 - DNA, 70 bp, Artificial Sequence
  Synthetic
gccaagcatttaggtgacactatagtagaaagcacagaaactgaggtttcagagctatgctggaaacagc

SEQ ID NO: 63443 - DNA, 70 bp, Artificial Sequence
  Synthetic
gccaagcatttaggtgacactatagcacgtttcgaacatccagaagtttcagagctatgctggaaacagc

SEQ ID NO: 63444 - DNA, 70 bp, Artificial Sequence
  Synthetic
gccaagcatttaggtgacactataggcagctcagaatgctttcaagtttcagagctatgctggaaacagc

SEQ ID NO: 63445 - DNA, 70 bp, Artificial Sequence
  Synthetic
gccaagcatttaggtgacactataggagaggaggactaattccccgtttcagagctatgctggaaacagc

SEQ ID NO: 63446 - DNA, 70 bp, Artificial Sequence
  Synthetic
gccaagcatttaggtgacactataggcatcccagtcaggggtcacgtttcagagctatgctggaaacagc

SEQ ID NO: 63447 - DNA, 70 bp, Artificial Sequence
  Synthetic
gccaagcatttaggtgacactatagggcccctcgccgcatcgttggtttcagagctatgctggaaacagc

SEQ ID NO: 63448 - DNA, 70 bp, Artificial Sequence
  Synthetic
gccaagcatttaggtgacactataggtggctggttcacatctcatgtttcagagctatgctggaaacagc

SEQ ID NO: 63449 - DNA, 70 bp, Artificial Sequence
  Synthetic
gccaagcatttaggtgacactatagtgtgcgcatcactggctgaggtttcagagctatgctggaaacagc

SEQ ID NO: 63450 - DNA, 70 bp, Artificial Sequence
  Synthetic
gccaagcatttaggtgacactataggccctctgtgctggagaagcgtttcagagctatgctggaaacagc

SEQ ID NO: 63451 - DNA, 70 bp, Artificial Sequence
  Synthetic
gccaagcatttaggtgacactatagaaactgtcgagcttcttcccgtttcagagctatgctggaaacagc

SEQ ID NO: 63452 - DNA, 70 bp, Artificial Sequence
  Synthetic
gccaagcatttaggtgacactatagagccagagcttctactgagggtttcagagctatgctggaaacagc

SEQ ID NO: 63453 - DNA, 70 bp, Artificial Sequence
  Synthetic
gccaagcatttaggtgacactatagcgcaatgtcaccatcctacggtttcagagctatgctggaaacagc

SEQ ID NO: 63454 - DNA, 70 bp, Artificial Sequence
  Synthetic
gccaagcatttaggtgacactataggtgtctgttgcatgtcacgcgtttcagagctatgctggaaacagc

SEQ ID NO: 63455 - DNA, 70 bp, Artificial Sequence
  Synthetic
gccaagcatttaggtgacactatagcagctgggaggctcaggctggtttcagagctatgctggaaacagc

SEQ ID NO: 63456 - DNA, 70 bp, Artificial Sequence
  Synthetic
gccaagcatttaggtgacactataggctgcaggaagcaaaactgtgtttcagagctatgctggaaacagc

SEQ ID NO: 63457 - DNA, 70 bp, Artificial Sequence
  Synthetic
gccaagcatttaggtgacactataggcaatgtttaggttcgaatggtttcagagctatgctggaaacagc

SEQ ID NO: 63458 - DNA, 70 bp, Artificial Sequence
  Synthetic
gccaagcatttaggtgacactatagattcaaggtcatcagggttcgtttcagagctatgctggaaacagc

SEQ ID NO: 63459 - DNA, 70 bp, Artificial Sequence
  Synthetic
gccaagcatttaggtgacactatagcgcgcacctccagcctagctgtttcagagctatgctggaaacagc

SEQ ID NO: 63460 - DNA, 70 bp, Artificial Sequence
  Synthetic
gccaagcatttaggtgacactataggacgagccacagcctgctacgtttcagagctatgctggaaacagc

SEQ ID NO: 63461 - DNA, 70 bp, Artificial Sequence
  Synthetic
gccaagcatttaggtgacactatagattgacagactcaacaaacagtttcagagctatgctggaaacagc

SEQ ID NO: 63462 - DNA, 70 bp, Artificial Sequence
  Synthetic
gccaagcatttaggtgacactatagggagatggaaactacaagaggtttcagagctatgctggaaacagc

SEQ ID NO: 63463 - DNA, 70 bp, Artificial Sequence
  Synthetic
gccaagcatttaggtgacactatagagcactgctgtctccagtccgtttcagagctatgctggaaacagc

SEQ ID NO: 63464 - DNA, 70 bp, Artificial Sequence
  Synthetic
gccaagcatttaggtgacactatagtgtccctggaggtattctgagtttcagagctatgctggaaacagc

SEQ ID NO: 63465 - DNA, 70 bp, Artificial Sequence
  Synthetic
gccaagcatttaggtgacactatagtacaagcgggtgatagtattgtttcagagctatgctggaaacagc

SEQ ID NO: 63466 - DNA, 70 bp, Artificial Sequence
  Synthetic
gccaagcatttaggtgacactatagattgtttttgtggtgggagggtttcagagctatgctggaaacagc

SEQ ID NO: 63467 - DNA, 70 bp, Artificial Sequence
  Synthetic
gccaagcatttaggtgacactatagtagcggatgctcagaagccagtttcagagctatgctggaaacagc

SEQ ID NO: 63468 - DNA, 70 bp, Artificial Sequence
  Synthetic
gccaagcatttaggtgacactataggcatattgctaagagagcaagtttcagagctatgctggaaacagc

SEQ ID NO: 63469 - DNA, 70 bp, Artificial Sequence
  Synthetic
gccaagcatttaggtgacactataggctgctataaatgcgcttgagtttcagagctatgctggaaacagc

SEQ ID NO: 63470 - DNA, 70 bp, Artificial Sequence
  Synthetic
gccaagcatttaggtgacactatagctagcatcttctctttactcgtttcagagctatgctggaaacagc

SEQ ID NO: 63471 - DNA, 70 bp, Artificial Sequence
  Synthetic
gccaagcatttaggtgacactataggctaattacacagtgagcttgtttcagagctatgctggaaacagc

SEQ ID NO: 63472 - DNA, 70 bp, Artificial Sequence
  Synthetic
gccaagcatttaggtgacactatagcagtcaggacggtgcctaaggtttcagagctatgctggaaacagc

SEQ ID NO: 63473 - DNA, 70 bp, Artificial Sequence
  Synthetic
gccaagcatttaggtgacactataggaagaaatgcgtggatacgagtttcagagctatgctggaaacagc

SEQ ID NO: 63474 - DNA, 70 bp, Artificial Sequence
  Synthetic
gccaagcatttaggtgacactatagaagcctcattgcggaagtccgtttcagagctatgctggaaacagc

SEQ ID NO: 63475 - DNA, 70 bp, Artificial Sequence
  Synthetic
gccaagcatttaggtgacactataggactctcattgaaaaagtccgtttcagagctatgctggaaacagc

SEQ ID NO: 63476 - DNA, 70 bp, Artificial Sequence
  Synthetic
gccaagcatttaggtgacactatagatacagtgtacgacagcattgtttcagagctatgctggaaacagc

SEQ ID NO: 63477 - DNA, 70 bp, Artificial Sequence
  Synthetic
gccaagcatttaggtgacactatagtgaaactctgagcaatgttggtttcagagctatgctggaaacagc

SEQ ID NO: 63478 - DNA, 70 bp, Artificial Sequence
  Synthetic
gccaagcatttaggtgacactataggcaggggtcctcagatcagagtttcagagctatgctggaaacagc

SEQ ID NO: 63479 - DNA, 70 bp, Artificial Sequence
  Synthetic
gccaagcatttaggtgacactatagcggctcagccaaacactgtcgtttcagagctatgctggaaacagc

SEQ ID NO: 63480 - DNA, 70 bp, Artificial Sequence
  Synthetic
gccaagcatttaggtgacactatagtgaagctgtgaagaaactgcgtttcagagctatgctggaaacagc

SEQ ID NO: 63481 - DNA, 70 bp, Artificial Sequence
  Synthetic
gccaagcatttaggtgacactataggcaaagcagtctgggattatgtttcagagctatgctggaaacagc

SEQ ID NO: 63482 - DNA, 70 bp, Artificial Sequence
  Synthetic
gccaagcatttaggtgacactatagatggcttcttttcactttgcgtttcagagctatgctggaaacagc

SEQ ID NO: 63483 - DNA, 70 bp, Artificial Sequence
  Synthetic
gccaagcatttaggtgacactatagcggaggctgaggtaggagaagtttcagagctatgctggaaacagc

SEQ ID NO: 63484 - DNA, 70 bp, Artificial Sequence
  Synthetic
gccaagcatttaggtgacactatagacatcgtcatagtcatcttcgtttcagagctatgctggaaacagc

SEQ ID NO: 63485 - DNA, 70 bp, Artificial Sequence
  Synthetic
gccaagcatttaggtgacactataggattccagcaagtggtaaatgtttcagagctatgctggaaacagc

SEQ ID NO: 63486 - DNA, 70 bp, Artificial Sequence
  Synthetic
gccaagcatttaggtgacactataggcaggagaatggcacgaatcgtttcagagctatgctggaaacagc

SEQ ID NO: 63487 - DNA, 70 bp, Artificial Sequence
  Synthetic
gccaagcatttaggtgacactatagagcagcctccctgatgaatcgtttcagagctatgctggaaacagc

SEQ ID NO: 63488 - DNA, 70 bp, Artificial Sequence
  Synthetic
gccaagcatttaggtgacactatagtgggcagctgaaatattaccgtttcagagctatgctggaaacagc

SEQ ID NO: 63489 - DNA, 70 bp, Artificial Sequence
  Synthetic
gccaagcatttaggtgacactatagggcggccccagtgctaggccgtttcagagctatgctggaaacagc

SEQ ID NO: 63490 - DNA, 70 bp, Artificial Sequence
  Synthetic
gccaagcatttaggtgacactatagagctctcctaccacattgacgtttcagagctatgctggaaacagc

SEQ ID NO: 63491 - DNA, 70 bp, Artificial Sequence
  Synthetic
gccaagcatttaggtgacactatagtacattgaccgacttaaacagtttcagagctatgctggaaacagc

SEQ ID NO: 63492 - DNA, 70 bp, Artificial Sequence
  Synthetic
gccaagcatttaggtgacactatagtagtaacacagctttaatgcgtttcagagctatgctggaaacagc

SEQ ID NO: 63493 - DNA, 70 bp, Artificial Sequence
  Synthetic
gccaagcatttaggtgacactatagcttgcttcagtttgtcaatggtttcagagctatgctggaaacagc

SEQ ID NO: 63494 - DNA, 70 bp, Artificial Sequence
  Synthetic
gccaagcatttaggtgacactataggtatggagctgattgcccctgtttcagagctatgctggaaacagc

SEQ ID NO: 63495 - DNA, 70 bp, Artificial Sequence
  Synthetic
gccaagcatttaggtgacactatagaggtgagggctcagtcacaggtttcagagctatgctggaaacagc

SEQ ID NO: 63496 - DNA, 70 bp, Artificial Sequence
  Synthetic
gccaagcatttaggtgacactatagggcaaagatgaaaaagccaagtttcagagctatgctggaaacagc

SEQ ID NO: 63497 - DNA, 70 bp, Artificial Sequence
  Synthetic
gccaagcatttaggtgacactatagccgatgtgtttctcggggtggtttcagagctatgctggaaacagc

SEQ ID NO: 63498 - DNA, 70 bp, Artificial Sequence
  Synthetic
gccaagcatttaggtgacactataggaactgcacgggcgtccagggtttcagagctatgctggaaacagc

SEQ ID NO: 63499 - DNA, 70 bp, Artificial Sequence
  Synthetic
gccaagcatttaggtgacactatagagacaaagggaaagatatcagtttcagagctatgctggaaacagc

SEQ ID NO: 63500 - DNA, 70 bp, Artificial Sequence
  Synthetic
gccaagcatttaggtgacactatagggatgatggcgccaagtagtgtttcagagctatgctggaaacagc

SEQ ID NO: 63501 - DNA, 70 bp, Artificial Sequence
  Synthetic
gccaagcatttaggtgacactatagttctcaaacttttccttgtcgtttcagagctatgctggaaacagc

SEQ ID NO: 63502 - DNA, 70 bp, Artificial Sequence
  Synthetic
gccaagcatttaggtgacactatagctcctgttctattcctccacgtttcagagctatgctggaaacagc

SEQ ID NO: 63503 - DNA, 70 bp, Artificial Sequence
  Synthetic
gccaagcatttaggtgacactatagcaaggagtctcttgtctagcgtttcagagctatgctggaaacagc

SEQ ID NO: 63504 - DNA, 70 bp, Artificial Sequence
  Synthetic
gccaagcatttaggtgacactataggctggccaccctggtcttgagtttcagagctatgctggaaacagc

SEQ ID NO: 63505 - DNA, 70 bp, Artificial Sequence
  Synthetic
gccaagcatttaggtgacactatagagcagggctcacacttttgagtttcagagctatgctggaaacagc

SEQ ID NO: 63506 - DNA, 70 bp, Artificial Sequence
  Synthetic
gccaagcatttaggtgacactatagccaggccgaggctcacacgagtttcagagctatgctggaaacagc

SEQ ID NO: 63507 - DNA, 70 bp, Artificial Sequence
  Synthetic
gccaagcatttaggtgacactataggtggtaagtggtattagatcgtttcagagctatgctggaaacagc

SEQ ID NO: 63508 - DNA, 70 bp, Artificial Sequence
  Synthetic
gccaagcatttaggtgacactatagtcagagaatccaagtgttaggtttcagagctatgctggaaacagc

SEQ ID NO: 63509 - DNA, 70 bp, Artificial Sequence
  Synthetic
gccaagcatttaggtgacactatagagacaaagggaaagacagcagtttcagagctatgctggaaacagc

SEQ ID NO: 63510 - DNA, 70 bp, Artificial Sequence
  Synthetic
gccaagcatttaggtgacactataggggaaaagggtatcagtccagtttcagagctatgctggaaacagc

SEQ ID NO: 63511 - DNA, 70 bp, Artificial Sequence
  Synthetic
gccaagcatttaggtgacactatagcctctgggggggccctgagagtttcagagctatgctggaaacagc

SEQ ID NO: 63512 - DNA, 70 bp, Artificial Sequence
  Synthetic
gccaagcatttaggtgacactatagtgggcaggggcagggttagagtttcagagctatgctggaaacagc

SEQ ID NO: 63513 - DNA, 70 bp, Artificial Sequence
  Synthetic
gccaagcatttaggtgacactataggccccagccccttgagactcgtttcagagctatgctggaaacagc

SEQ ID NO: 63514 - DNA, 70 bp, Artificial Sequence
  Synthetic
gccaagcatttaggtgacactatagcagatgctggatgagctctggtttcagagctatgctggaaacagc

SEQ ID NO: 63515 - DNA, 70 bp, Artificial Sequence
  Synthetic
gccaagcatttaggtgacactatagggctagctcttttttctgtagtttcagagctatgctggaaacagc

SEQ ID NO: 63516 - DNA, 70 bp, Artificial Sequence
  Synthetic
gccaagcatttaggtgacactatagagactgcagtggctcaagacgtttcagagctatgctggaaacagc

SEQ ID NO: 63517 - DNA, 70 bp, Artificial Sequence
  Synthetic
gccaagcatttaggtgacactatagtgcaagagtagatgcagttagtttcagagctatgctggaaacagc

SEQ ID NO: 63518 - DNA, 70 bp, Artificial Sequence
  Synthetic
gccaagcatttaggtgacactatagcttcagagcttagcgttgccgtttcagagctatgctggaaacagc

SEQ ID NO: 63519 - DNA, 70 bp, Artificial Sequence
  Synthetic
gccaagcatttaggtgacactatagtatcaggaaatttcaagagcgtttcagagctatgctggaaacagc

SEQ ID NO: 63520 - DNA, 70 bp, Artificial Sequence
  Synthetic
gccaagcatttaggtgacactatagttttaccagtcattaaagccgtttcagagctatgctggaaacagc

SEQ ID NO: 63521 - DNA, 70 bp, Artificial Sequence
  Synthetic
gccaagcatttaggtgacactatagggaaagggttttcaaagactgtttcagagctatgctggaaacagc

SEQ ID NO: 63522 - DNA, 70 bp, Artificial Sequence
  Synthetic
gccaagcatttaggtgacactataggtgactcagcaagaataggagtttcagagctatgctggaaacagc

SEQ ID NO: 63523 - DNA, 70 bp, Artificial Sequence
  Synthetic
gccaagcatttaggtgacactatagggaatcacgaaagagatcttgtttcagagctatgctggaaacagc

SEQ ID NO: 63524 - DNA, 70 bp, Artificial Sequence
  Synthetic
gccaagcatttaggtgacactataggaggtgcctgctcctctagggtttcagagctatgctggaaacagc

SEQ ID NO: 63525 - DNA, 70 bp, Artificial Sequence
  Synthetic
gccaagcatttaggtgacactatagtttctatgactgtgttgacagtttcagagctatgctggaaacagc

SEQ ID NO: 63526 - DNA, 70 bp, Artificial Sequence
  Synthetic
gccaagcatttaggtgacactatagaggtatcccccagggagtaggtttcagagctatgctggaaacagc

SEQ ID NO: 63527 - DNA, 70 bp, Artificial Sequence
  Synthetic
gccaagcatttaggtgacactatagatgaagcttacgcataagccgtttcagagctatgctggaaacagc

SEQ ID NO: 63528 - DNA, 70 bp, Artificial Sequence
  Synthetic
gccaagcatttaggtgacactatagtcaaaacaagcatcttgatggtttcagagctatgctggaaacagc

SEQ ID NO: 63529 - DNA, 70 bp, Artificial Sequence
  Synthetic
gccaagcatttaggtgacactatagagccctgtgcaggcctaggggtttcagagctatgctggaaacagc

SEQ ID NO: 63530 - DNA, 70 bp, Artificial Sequence
  Synthetic
gccaagcatttaggtgacactatagggcgaggcggaaggctcagcgtttcagagctatgctggaaacagc

SEQ ID NO: 63531 - DNA, 70 bp, Artificial Sequence
  Synthetic
gccaagcatttaggtgacactataggagggggttccttcctcatcgtttcagagctatgctggaaacagc

SEQ ID NO: 63532 - DNA, 70 bp, Artificial Sequence
  Synthetic
gccaagcatttaggtgacactatagcaggaccagcatcatctgaggtttcagagctatgctggaaacagc

SEQ ID NO: 63533 - DNA, 70 bp, Artificial Sequence
  Synthetic
gccaagcatttaggtgacactatagctgcggccctacaaataaccgtttcagagctatgctggaaacagc

SEQ ID NO: 63534 - DNA, 70 bp, Artificial Sequence
  Synthetic
gccaagcatttaggtgacactatagcgtgggctgagtcatttgtagtttcagagctatgctggaaacagc

SEQ ID NO: 63535 - DNA, 70 bp, Artificial Sequence
  Synthetic
gccaagcatttaggtgacactatagagcctagggttactatttgtgtttcagagctatgctggaaacagc

SEQ ID NO: 63536 - DNA, 70 bp, Artificial Sequence
  Synthetic
gccaagcatttaggtgacactataggacagcgattcgcagttagggtttcagagctatgctggaaacagc

SEQ ID NO: 63537 - DNA, 70 bp, Artificial Sequence
  Synthetic
gccaagcatttaggtgacactatagccacggttcagtccagcttcgtttcagagctatgctggaaacagc

SEQ ID NO: 63538 - DNA, 70 bp, Artificial Sequence
  Synthetic
gccaagcatttaggtgacactatagattgctagctgaactgctatgtttcagagctatgctggaaacagc

SEQ ID NO: 63539 - DNA, 70 bp, Artificial Sequence
  Synthetic
gccaagcatttaggtgacactatagtgaactgggaagataataacgtttcagagctatgctggaaacagc

SEQ ID NO: 63540 - DNA, 70 bp, Artificial Sequence
  Synthetic
gccaagcatttaggtgacactatagttccttccgagaaaaacagtgtttcagagctatgctggaaacagc

SEQ ID NO: 63541 - DNA, 70 bp, Artificial Sequence
  Synthetic
gccaagcatttaggtgacactataggaggaattctatgcctgacggtttcagagctatgctggaaacagc

SEQ ID NO: 63542 - DNA, 70 bp, Artificial Sequence
  Synthetic
gccaagcatttaggtgacactatagtacgcataaaactccttagtgtttcagagctatgctggaaacagc

SEQ ID NO: 63543 - DNA, 70 bp, Artificial Sequence
  Synthetic
gccaagcatttaggtgacactatagaggaggagttctatgcctaggtttcagagctatgctggaaacagc

SEQ ID NO: 63544 - DNA, 70 bp, Artificial Sequence
  Synthetic
gccaagcatttaggtgacactataggcttcacgcgtagaactcatgtttcagagctatgctggaaacagc

SEQ ID NO: 63545 - DNA, 70 bp, Artificial Sequence
  Synthetic
gccaagcatttaggtgacactatagtgccgtgaattttaaacctcgtttcagagctatgctggaaacagc

SEQ ID NO: 63546 - DNA, 70 bp, Artificial Sequence
  Synthetic
gccaagcatttaggtgacactatagctgcagtggcttcaggcatcgtttcagagctatgctggaaacagc

SEQ ID NO: 63547 - DNA, 70 bp, Artificial Sequence
  Synthetic
gccaagcatttaggtgacactataggacgaggaggaagactcttggtttcagagctatgctggaaacagc

SEQ ID NO: 63548 - DNA, 70 bp, Artificial Sequence
  Synthetic
gccaagcatttaggtgacactatagccacaatctgattgctgaccgtttcagagctatgctggaaacagc

SEQ ID NO: 63549 - DNA, 70 bp, Artificial Sequence
  Synthetic
gccaagcatttaggtgacactatagtatttgccaagcctttgaaagtttcagagctatgctggaaacagc

SEQ ID NO: 63550 - DNA, 70 bp, Artificial Sequence
  Synthetic
gccaagcatttaggtgacactatagtctagattcacagctctgcagtttcagagctatgctggaaacagc

SEQ ID NO: 63551 - DNA, 70 bp, Artificial Sequence
  Synthetic
gccaagcatttaggtgacactataggagttcatcgtgacctgcaggtttcagagctatgctggaaacagc

SEQ ID NO: 63552 - DNA, 70 bp, Artificial Sequence
  Synthetic
gccaagcatttaggtgacactatagagcgcgttgtactcgttcatgtttcagagctatgctggaaacagc

SEQ ID NO: 63553 - DNA, 70 bp, Artificial Sequence
  Synthetic
gccaagcatttaggtgacactatagctacgcgcgcagcgtgcacggtttcagagctatgctggaaacagc

SEQ ID NO: 63554 - DNA, 70 bp, Artificial Sequence
  Synthetic
gccaagcatttaggtgacactatagccacatcttgtctcatcagtgtttcagagctatgctggaaacagc

SEQ ID NO: 63555 - DNA, 70 bp, Artificial Sequence
  Synthetic
gccaagcatttaggtgacactatagccgccccgacggacggtgacgtttcagagctatgctggaaacagc

SEQ ID NO: 63556 - DNA, 70 bp, Artificial Sequence
  Synthetic
gccaagcatttaggtgacactatagccgtggagcacagctcaacggtttcagagctatgctggaaacagc

SEQ ID NO: 63557 - DNA, 70 bp, Artificial Sequence
  Synthetic
gccaagcatttaggtgacactatagaagaagccacaaaacccaatgtttcagagctatgctggaaacagc

SEQ ID NO: 63558 - DNA, 70 bp, Artificial Sequence
  Synthetic
gccaagcatttaggtgacactatagtatggagattgggaacgaaagtttcagagctatgctggaaacagc

SEQ ID NO: 63559 - DNA, 70 bp, Artificial Sequence
  Synthetic
gccaagcatttaggtgacactatagtgaagctttcttctccttatgtttcagagctatgctggaaacagc

SEQ ID NO: 63560 - DNA, 70 bp, Artificial Sequence
  Synthetic
gccaagcatttaggtgacactataggggagcctcctttcttcacagtttcagagctatgctggaaacagc

SEQ ID NO: 63561 - DNA, 70 bp, Artificial Sequence
  Synthetic
gccaagcatttaggtgacactatagaaataaggagaacttttcccgtttcagagctatgctggaaacagc

SEQ ID NO: 63562 - DNA, 70 bp, Artificial Sequence
  Synthetic
gccaagcatttaggtgacactatagcccctgtaatgccagctactgtttcagagctatgctggaaacagc

SEQ ID NO: 63563 - DNA, 70 bp, Artificial Sequence
  Synthetic
gccaagcatttaggtgacactatagaggtcagagcttccacagcagtttcagagctatgctggaaacagc

SEQ ID NO: 63564 - DNA, 70 bp, Artificial Sequence
  Synthetic
gccaagcatttaggtgacactataggcggcgctttgctcacacgagtttcagagctatgctggaaacagc

SEQ ID NO: 63565 - DNA, 70 bp, Artificial Sequence
  Synthetic
gccaagcatttaggtgacactataggggtcagcgtcctggtagcagtttcagagctatgctggaaacagc

SEQ ID NO: 63566 - DNA, 70 bp, Artificial Sequence
  Synthetic
gccaagcatttaggtgacactatagggctcccgggctcccatagcgtttcagagctatgctggaaacagc

SEQ ID NO: 63567 - DNA, 70 bp, Artificial Sequence
  Synthetic
gccaagcatttaggtgacactatagggcatccttcatgcaatggagtttcagagctatgctggaaacagc

SEQ ID NO: 63568 - DNA, 70 bp, Artificial Sequence
  Synthetic
gccaagcatttaggtgacactataggtcacagacttagtgaataggtttcagagctatgctggaaacagc

SEQ ID NO: 63569 - DNA, 70 bp, Artificial Sequence
  Synthetic
gccaagcatttaggtgacactatagaaggaaattgtagcctaagtgtttcagagctatgctggaaacagc

SEQ ID NO: 63570 - DNA, 70 bp, Artificial Sequence
  Synthetic
gccaagcatttaggtgacactatagctgtgattctgtcactgtgagtttcagagctatgctggaaacagc

SEQ ID NO: 63571 - DNA, 70 bp, Artificial Sequence
  Synthetic
gccaagcatttaggtgacactatagccagcggacagtgtctaaacgtttcagagctatgctggaaacagc

SEQ ID NO: 63572 - DNA, 70 bp, Artificial Sequence
  Synthetic
gccaagcatttaggtgacactataggtaaggggtccgtcctcactgtttcagagctatgctggaaacagc

SEQ ID NO: 63573 - DNA, 70 bp, Artificial Sequence
  Synthetic
gccaagcatttaggtgacactatagccacctgggccaggtctgaggtttcagagctatgctggaaacagc

SEQ ID NO: 63574 - DNA, 70 bp, Artificial Sequence
  Synthetic
gccaagcatttaggtgacactatagcttggccattgtcgtcaatggtttcagagctatgctggaaacagc

SEQ ID NO: 63575 - DNA, 70 bp, Artificial Sequence
  Synthetic
gccaagcatttaggtgacactatagagaacagttcagtggaggacgtttcagagctatgctggaaacagc

SEQ ID NO: 63576 - DNA, 70 bp, Artificial Sequence
  Synthetic
gccaagcatttaggtgacactatagagtagatactggtctgtgatgtttcagagctatgctggaaacagc

SEQ ID NO: 63577 - DNA, 70 bp, Artificial Sequence
  Synthetic
gccaagcatttaggtgacactatagtttgctgggtttattcgtgcgtttcagagctatgctggaaacagc

SEQ ID NO: 63578 - DNA, 70 bp, Artificial Sequence
  Synthetic
gccaagcatttaggtgacactatagtatgctcttttggctgtaatgtttcagagctatgctggaaacagc

SEQ ID NO: 63579 - DNA, 70 bp, Artificial Sequence
  Synthetic
gccaagcatttaggtgacactatagcttgtcactgctcgttctgcgtttcagagctatgctggaaacagc

SEQ ID NO: 63580 - DNA, 70 bp, Artificial Sequence
  Synthetic
gccaagcatttaggtgacactatagtgctctagagcaatcatgtcgtttcagagctatgctggaaacagc

SEQ ID NO: 63581 - DNA, 70 bp, Artificial Sequence
  Synthetic
gccaagcatttaggtgacactataggcaggcagcgcggcactaccgtttcagagctatgctggaaacagc

SEQ ID NO: 63582 - DNA, 70 bp, Artificial Sequence
  Synthetic
gccaagcatttaggtgacactatagtggagatcatggagctggaggtttcagagctatgctggaaacagc

SEQ ID NO: 63583 - DNA, 70 bp, Artificial Sequence
  Synthetic
gccaagcatttaggtgacactatagataggagaaggtgttatttcgtttcagagctatgctggaaacagc

SEQ ID NO: 63584 - DNA, 70 bp, Artificial Sequence
  Synthetic
gccaagcatttaggtgacactatagcctcttcctccatggattttgtttcagagctatgctggaaacagc

SEQ ID NO: 63585 - DNA, 70 bp, Artificial Sequence
  Synthetic
gccaagcatttaggtgacactatagggagctcacccctgtctagggtttcagagctatgctggaaacagc

SEQ ID NO: 63586 - DNA, 70 bp, Artificial Sequence
  Synthetic
gccaagcatttaggtgacactatagagcctcacctgcctccaggcgtttcagagctatgctggaaacagc

SEQ ID NO: 63587 - DNA, 70 bp, Artificial Sequence
  Synthetic
gccaagcatttaggtgacactatagggctggggtcttcactgtgtgtttcagagctatgctggaaacagc

SEQ ID NO: 63588 - DNA, 70 bp, Artificial Sequence
  Synthetic
gccaagcatttaggtgacactatagtccctggtctccagatagccgtttcagagctatgctggaaacagc

SEQ ID NO: 63589 - DNA, 70 bp, Artificial Sequence
  Synthetic
gccaagcatttaggtgacactatagggagaagatggagaaattctgtttcagagctatgctggaaacagc

SEQ ID NO: 63590 - DNA, 70 bp, Artificial Sequence
  Synthetic
gccaagcatttaggtgacactatagtgatgcgtttagaatgaaccgtttcagagctatgctggaaacagc

SEQ ID NO: 63591 - DNA, 70 bp, Artificial Sequence
  Synthetic
gccaagcatttaggtgacactataggaagcacctggtgctgaactgtttcagagctatgctggaaacagc

SEQ ID NO: 63592 - DNA, 70 bp, Artificial Sequence
  Synthetic
gccaagcatttaggtgacactatagacgtgtgtttattctcagcagtttcagagctatgctggaaacagc

SEQ ID NO: 63593 - DNA, 70 bp, Artificial Sequence
  Synthetic
gccaagcatttaggtgacactatagatggtgtcagacatcataatgtttcagagctatgctggaaacagc

SEQ ID NO: 63594 - DNA, 70 bp, Artificial Sequence
  Synthetic
gccaagcatttaggtgacactatagtagtgtatgtccgattctgggtttcagagctatgctggaaacagc

SEQ ID NO: 63595 - DNA, 70 bp, Artificial Sequence
  Synthetic
gccaagcatttaggtgacactatagcagtctgactgtggagtatggtttcagagctatgctggaaacagc

SEQ ID NO: 63596 - DNA, 70 bp, Artificial Sequence
  Synthetic
gccaagcatttaggtgacactatagtcaggggtggctggctcacggtttcagagctatgctggaaacagc

SEQ ID NO: 63597 - DNA, 70 bp, Artificial Sequence
  Synthetic
gccaagcatttaggtgacactatagattagcacttcaagcagcacgtttcagagctatgctggaaacagc

SEQ ID NO: 63598 - DNA, 70 bp, Artificial Sequence
  Synthetic
gccaagcatttaggtgacactatagggttgtatcctcagcttaacgtttcagagctatgctggaaacagc

SEQ ID NO: 63599 - DNA, 70 bp, Artificial Sequence
  Synthetic
gccaagcatttaggtgacactatagaactgaagtttgatcaatgcgtttcagagctatgctggaaacagc

SEQ ID NO: 63600 - DNA, 70 bp, Artificial Sequence
  Synthetic
gccaagcatttaggtgacactatagcctctcactgtattatctcagtttcagagctatgctggaaacagc

SEQ ID NO: 63601 - DNA, 70 bp, Artificial Sequence
  Synthetic
gccaagcatttaggtgacactatagcttgttgctgtatatgcaacgtttcagagctatgctggaaacagc

SEQ ID NO: 63602 - DNA, 70 bp, Artificial Sequence
  Synthetic
gccaagcatttaggtgacactatagaagaaaatgcagcctctgtcgtttcagagctatgctggaaacagc

SEQ ID NO: 63603 - DNA, 70 bp, Artificial Sequence
  Synthetic
gccaagcatttaggtgacactataggtcatatgcacaaggagattgtttcagagctatgctggaaacagc

SEQ ID NO: 63604 - DNA, 70 bp, Artificial Sequence
  Synthetic
gccaagcatttaggtgacactatagtttcctttgttgtgttcacagtttcagagctatgctggaaacagc

SEQ ID NO: 63605 - DNA, 70 bp, Artificial Sequence
  Synthetic
gccaagcatttaggtgacactatagcaataagctgggtgtctaaagtttcagagctatgctggaaacagc

SEQ ID NO: 63606 - DNA, 70 bp, Artificial Sequence
  Synthetic
gccaagcatttaggtgacactatagcatcatcgctcataagctgcgtttcagagctatgctggaaacagc

SEQ ID NO: 63607 - DNA, 70 bp, Artificial Sequence
  Synthetic
gccaagcatttaggtgacactatagggagacgggctcagaagagcgtttcagagctatgctggaaacagc

SEQ ID NO: 63608 - DNA, 70 bp, Artificial Sequence
  Synthetic
gccaagcatttaggtgacactatagcaggccgaagttggtgggatgtttcagagctatgctggaaacagc

SEQ ID NO: 63609 - DNA, 70 bp, Artificial Sequence
  Synthetic
gccaagcatttaggtgacactatagttaagaaggtggaagggagagtttcagagctatgctggaaacagc

SEQ ID NO: 63610 - DNA, 70 bp, Artificial Sequence
  Synthetic
gccaagcatttaggtgacactatagagaagactcataaccaatacgtttcagagctatgctggaaacagc

SEQ ID NO: 63611 - DNA, 70 bp, Artificial Sequence
  Synthetic
gccaagcatttaggtgacactatagattgccatggcaacagcaatgtttcagagctatgctggaaacagc

SEQ ID NO: 63612 - DNA, 70 bp, Artificial Sequence
  Synthetic
gccaagcatttaggtgacactataggatgaggaagaggaaaatgagtttcagagctatgctggaaacagc

SEQ ID NO: 63613 - DNA, 70 bp, Artificial Sequence
  Synthetic
gccaagcatttaggtgacactatagtagctttgaggaagaagagggtttcagagctatgctggaaacagc

SEQ ID NO: 63614 - DNA, 70 bp, Artificial Sequence
  Synthetic
gccaagcatttaggtgacactatagttgagaggttgaagcctccagtttcagagctatgctggaaacagc

SEQ ID NO: 63615 - DNA, 70 bp, Artificial Sequence
  Synthetic
gccaagcatttaggtgacactataggttgagcgagctgcagttgcgtttcagagctatgctggaaacagc

SEQ ID NO: 63616 - DNA, 70 bp, Artificial Sequence
  Synthetic
gccaagcatttaggtgacactatagtctgccttgcaggcggctatgtttcagagctatgctggaaacagc

SEQ ID NO: 63617 - DNA, 70 bp, Artificial Sequence
  Synthetic
gccaagcatttaggtgacactatagatcccttacctgagaatgaagtttcagagctatgctggaaacagc

SEQ ID NO: 63618 - DNA, 70 bp, Artificial Sequence
  Synthetic
gccaagcatttaggtgacactatagtcattaaatggatcttctgcgtttcagagctatgctggaaacagc

SEQ ID NO: 63619 - DNA, 70 bp, Artificial Sequence
  Synthetic
gccaagcatttaggtgacactataggcagcagccaccacagtaatgtttcagagctatgctggaaacagc

SEQ ID NO: 63620 - DNA, 70 bp, Artificial Sequence
  Synthetic
gccaagcatttaggtgacactatagtctaatagcccacatggtttgtttcagagctatgctggaaacagc

SEQ ID NO: 63621 - DNA, 70 bp, Artificial Sequence
  Synthetic
gccaagcatttaggtgacactatagtgtgatccgcatcctacccagtttcagagctatgctggaaacagc

SEQ ID NO: 63622 - DNA, 70 bp, Artificial Sequence
  Synthetic
gccaagcatttaggtgacactataggagtgcacagttcacccacggtttcagagctatgctggaaacagc

SEQ ID NO: 63623 - DNA, 70 bp, Artificial Sequence
  Synthetic
gccaagcatttaggtgacactatagaaaggatgtaagaaggctttgtttcagagctatgctggaaacagc

SEQ ID NO: 63624 - DNA, 70 bp, Artificial Sequence
  Synthetic
gccaagcatttaggtgacactataggcgattgtagctctgacatcgtttcagagctatgctggaaacagc

SEQ ID NO: 63625 - DNA, 70 bp, Artificial Sequence
  Synthetic
gccaagcatttaggtgacactatagggagctattcttgaagtttggtttcagagctatgctggaaacagc

SEQ ID NO: 63626 - DNA, 70 bp, Artificial Sequence
  Synthetic
gccaagcatttaggtgacactatagcggcggggagggaatggagggtttcagagctatgctggaaacagc

SEQ ID NO: 63627 - DNA, 70 bp, Artificial Sequence
  Synthetic
gccaagcatttaggtgacactatagaaaccaaactcagattgactgtttcagagctatgctggaaacagc

SEQ ID NO: 63628 - DNA, 70 bp, Artificial Sequence
  Synthetic
gccaagcatttaggtgacactatagcctccaatggctggtggatggtttcagagctatgctggaaacagc

SEQ ID NO: 63629 - DNA, 70 bp, Artificial Sequence
  Synthetic
gccaagcatttaggtgacactatagcgccgcgcccccggacctacgtttcagagctatgctggaaacagc

SEQ ID NO: 63630 - DNA, 70 bp, Artificial Sequence
  Synthetic
gccaagcatttaggtgacactatagctggatgaccagtcctgctggtttcagagctatgctggaaacagc

SEQ ID NO: 63631 - DNA, 70 bp, Artificial Sequence
  Synthetic
gccaagcatttaggtgacactatagcacagttctgctgcccagaggtttcagagctatgctggaaacagc

SEQ ID NO: 63632 - DNA, 70 bp, Artificial Sequence
  Synthetic
gccaagcatttaggtgacactatagtcttgtaaatcttcacttgcgtttcagagctatgctggaaacagc

SEQ ID NO: 63633 - DNA, 70 bp, Artificial Sequence
  Synthetic
gccaagcatttaggtgacactatagggcccgtcatctggcggatggtttcagagctatgctggaaacagc

SEQ ID NO: 63634 - DNA, 70 bp, Artificial Sequence
  Synthetic
gccaagcatttaggtgacactatagataggtggtgctatgatcgagtttcagagctatgctggaaacagc

SEQ ID NO: 63635 - DNA, 70 bp, Artificial Sequence
  Synthetic
gccaagcatttaggtgacactataggaacttcgcgctggacaagagtttcagagctatgctggaaacagc

SEQ ID NO: 63636 - DNA, 70 bp, Artificial Sequence
  Synthetic
gccaagcatttaggtgacactataggatgggtgggtttctgattggtttcagagctatgctggaaacagc

SEQ ID NO: 63637 - DNA, 70 bp, Artificial Sequence
  Synthetic
gccaagcatttaggtgacactatagtcaccaagggcgatttaatagtttcagagctatgctggaaacagc

SEQ ID NO: 63638 - DNA, 70 bp, Artificial Sequence
  Synthetic
gccaagcatttaggtgacactataggcatttgacccgagtccttagtttcagagctatgctggaaacagc

SEQ ID NO: 63639 - DNA, 70 bp, Artificial Sequence
  Synthetic
gccaagcatttaggtgacactatagcagatggcagagtgagctaagtttcagagctatgctggaaacagc

SEQ ID NO: 63640 - DNA, 70 bp, Artificial Sequence
  Synthetic
gccaagcatttaggtgacactatagttgggatgatgacaatgtaggtttcagagctatgctggaaacagc

SEQ ID NO: 63641 - DNA, 70 bp, Artificial Sequence
  Synthetic
gccaagcatttaggtgacactatagtgctagcaagttctttctgcgtttcagagctatgctggaaacagc

SEQ ID NO: 63642 - DNA, 70 bp, Artificial Sequence
  Synthetic
gccaagcatttaggtgacactatagtaatgcagctcagacactccgtttcagagctatgctggaaacagc

SEQ ID NO: 63643 - DNA, 70 bp, Artificial Sequence
  Synthetic
gccaagcatttaggtgacactatagggccgcgcagcgcaacgcacgtttcagagctatgctggaaacagc

SEQ ID NO: 63644 - DNA, 70 bp, Artificial Sequence
  Synthetic
gccaagcatttaggtgacactataggtcggaaaagtagaaacagggtttcagagctatgctggaaacagc

SEQ ID NO: 63645 - DNA, 70 bp, Artificial Sequence
  Synthetic
gccaagcatttaggtgacactatagaactacgtggctacagctctgtttcagagctatgctggaaacagc

SEQ ID NO: 63646 - DNA, 70 bp, Artificial Sequence
  Synthetic
gccaagcatttaggtgacactatagcacacgctggactcctgatggtttcagagctatgctggaaacagc

SEQ ID NO: 63647 - DNA, 70 bp, Artificial Sequence
  Synthetic
gccaagcatttaggtgacactatagcaccaccctccggacacatggtttcagagctatgctggaaacagc

SEQ ID NO: 63648 - DNA, 70 bp, Artificial Sequence
  Synthetic
gccaagcatttaggtgacactataggaggtggaggccacgtagaagtttcagagctatgctggaaacagc

SEQ ID NO: 63649 - DNA, 70 bp, Artificial Sequence
  Synthetic
gccaagcatttaggtgacactatagcaacaactgcctaggcactggtttcagagctatgctggaaacagc

SEQ ID NO: 63650 - DNA, 70 bp, Artificial Sequence
  Synthetic
gccaagcatttaggtgacactatagctcggagatccgtgactctggtttcagagctatgctggaaacagc

SEQ ID NO: 63651 - DNA, 70 bp, Artificial Sequence
  Synthetic
gccaagcatttaggtgacactatagtggaactggacttgctcacagtttcagagctatgctggaaacagc

SEQ ID NO: 63652 - DNA, 70 bp, Artificial Sequence
  Synthetic
gccaagcatttaggtgacactatagcgaggagtcatcagtatgaggtttcagagctatgctggaaacagc

SEQ ID NO: 63653 - DNA, 70 bp, Artificial Sequence
  Synthetic
gccaagcatttaggtgacactatagtcagacgcagatggagactggtttcagagctatgctggaaacagc

SEQ ID NO: 63654 - DNA, 70 bp, Artificial Sequence
  Synthetic
gccaagcatttaggtgacactataggactccttcctggtggctacgtttcagagctatgctggaaacagc

SEQ ID NO: 63655 - DNA, 70 bp, Artificial Sequence
  Synthetic
gccaagcatttaggtgacactataggtcatttgcccagctctagagtttcagagctatgctggaaacagc

SEQ ID NO: 63656 - DNA, 70 bp, Artificial Sequence
  Synthetic
gccaagcatttaggtgacactatagaaggaagcacacgcagctcggtttcagagctatgctggaaacagc

SEQ ID NO: 63657 - DNA, 70 bp, Artificial Sequence
  Synthetic
gccaagcatttaggtgacactatagcatactcttgagaatgaccagtttcagagctatgctggaaacagc

SEQ ID NO: 63658 - DNA, 70 bp, Artificial Sequence
  Synthetic
gccaagcatttaggtgacactatagacttcaacccacatctcactgtttcagagctatgctggaaacagc

SEQ ID NO: 63659 - DNA, 70 bp, Artificial Sequence
  Synthetic
gccaagcatttaggtgacactatagaggacggcggtatcagctgtgtttcagagctatgctggaaacagc

SEQ ID NO: 63660 - DNA, 70 bp, Artificial Sequence
  Synthetic
gccaagcatttaggtgacactatagggattatgtacacgcatcatgtttcagagctatgctggaaacagc

SEQ ID NO: 63661 - DNA, 70 bp, Artificial Sequence
  Synthetic
gccaagcatttaggtgacactataggcgccccccgtgccctaggcgtttcagagctatgctggaaacagc

SEQ ID NO: 63662 - DNA, 70 bp, Artificial Sequence
  Synthetic
gccaagcatttaggtgacactatagcggccgtttcaacttttaaagtttcagagctatgctggaaacagc

SEQ ID NO: 63663 - DNA, 70 bp, Artificial Sequence
  Synthetic
gccaagcatttaggtgacactatagagcctacaaccatgcaaagtgtttcagagctatgctggaaacagc

SEQ ID NO: 63664 - DNA, 70 bp, Artificial Sequence
  Synthetic
gccaagcatttaggtgacactatagaggtgatgaggacattcatggtttcagagctatgctggaaacagc

SEQ ID NO: 63665 - DNA, 70 bp, Artificial Sequence
  Synthetic
gccaagcatttaggtgacactatagttgttcagtggtctgacagagtttcagagctatgctggaaacagc

SEQ ID NO: 63666 - DNA, 70 bp, Artificial Sequence
  Synthetic
gccaagcatttaggtgacactatagccagcctcgggaggccctaggtttcagagctatgctggaaacagc

SEQ ID NO: 63667 - DNA, 70 bp, Artificial Sequence
  Synthetic
gccaagcatttaggtgacactatagagatgacagtgatcgtcattgtttcagagctatgctggaaacagc

SEQ ID NO: 63668 - DNA, 70 bp, Artificial Sequence
  Synthetic
gccaagcatttaggtgacactatagcaacagggctatgtagatatgtttcagagctatgctggaaacagc

SEQ ID NO: 63669 - DNA, 70 bp, Artificial Sequence
  Synthetic
gccaagcatttaggtgacactatagacagtcttcacaagagttttgtttcagagctatgctggaaacagc

SEQ ID NO: 63670 - DNA, 70 bp, Artificial Sequence
  Synthetic
gccaagcatttaggtgacactatagctcacagcaactgctgatgagtttcagagctatgctggaaacagc

SEQ ID NO: 63671 - DNA, 70 bp, Artificial Sequence
  Synthetic
gccaagcatttaggtgacactatagacttcgtcggcagatctacagtttcagagctatgctggaaacagc

SEQ ID NO: 63672 - DNA, 70 bp, Artificial Sequence
  Synthetic
gccaagcatttaggtgacactatagctgagtttcagtccatgagcgtttcagagctatgctggaaacagc

SEQ ID NO: 63673 - DNA, 70 bp, Artificial Sequence
  Synthetic
gccaagcatttaggtgacactatagacagaagcacctttaggcgagtttcagagctatgctggaaacagc

SEQ ID NO: 63674 - DNA, 70 bp, Artificial Sequence
  Synthetic
gccaagcatttaggtgacactataggacctgcactgtctaaatgagtttcagagctatgctggaaacagc

SEQ ID NO: 63675 - DNA, 70 bp, Artificial Sequence
  Synthetic
gccaagcatttaggtgacactatagacttcatttacagcaacagagtttcagagctatgctggaaacagc

SEQ ID NO: 63676 - DNA, 70 bp, Artificial Sequence
  Synthetic
gccaagcatttaggtgacactatagtctaaggttcacaaaccttcgtttcagagctatgctggaaacagc

SEQ ID NO: 63677 - DNA, 70 bp, Artificial Sequence
  Synthetic
gccaagcatttaggtgacactatagtagctactttttagcaagtggtttcagagctatgctggaaacagc

SEQ ID NO: 63678 - DNA, 70 bp, Artificial Sequence
  Synthetic
gccaagcatttaggtgacactatagtttctgtctagattaagagggtttcagagctatgctggaaacagc

SEQ ID NO: 63679 - DNA, 70 bp, Artificial Sequence
  Synthetic
gccaagcatttaggtgacactataggttctttcatctcacgagctgtttcagagctatgctggaaacagc

SEQ ID NO: 63680 - DNA, 70 bp, Artificial Sequence
  Synthetic
gccaagcatttaggtgacactatagcatgtcatgaagaagcatccgtttcagagctatgctggaaacagc

SEQ ID NO: 63681 - DNA, 70 bp, Artificial Sequence
  Synthetic
gccaagcatttaggtgacactatagcgggcggggcgtggcctcaggtttcagagctatgctggaaacagc

SEQ ID NO: 63682 - DNA, 70 bp, Artificial Sequence
  Synthetic
gccaagcatttaggtgacactatagacttgtagtatcattcactcgtttcagagctatgctggaaacagc

SEQ ID NO: 63683 - DNA, 70 bp, Artificial Sequence
  Synthetic
gccaagcatttaggtgacactatagcaagcttcattctctcttctgtttcagagctatgctggaaacagc

SEQ ID NO: 63684 - DNA, 70 bp, Artificial Sequence
  Synthetic
gccaagcatttaggtgacactatagcaaggaccgtaagaagtaaggtttcagagctatgctggaaacagc

SEQ ID NO: 63685 - DNA, 70 bp, Artificial Sequence
  Synthetic
gccaagcatttaggtgacactatagcagcaacctgaggaaggacagtttcagagctatgctggaaacagc

SEQ ID NO: 63686 - DNA, 70 bp, Artificial Sequence
  Synthetic
gccaagcatttaggtgacactatagccagcaaaccaagaaagacagtttcagagctatgctggaaacagc

SEQ ID NO: 63687 - DNA, 70 bp, Artificial Sequence
  Synthetic
gccaagcatttaggtgacactatagactcatcatcagaatcgtcagtttcagagctatgctggaaacagc

SEQ ID NO: 63688 - DNA, 70 bp, Artificial Sequence
  Synthetic
gccaagcatttaggtgacactatagcagctgagtctgcagtgcttgtttcagagctatgctggaaacagc

SEQ ID NO: 63689 - DNA, 70 bp, Artificial Sequence
  Synthetic
gccaagcatttaggtgacactataggctctcgggcaccacgtgtagtttcagagctatgctggaaacagc

SEQ ID NO: 63690 - DNA, 70 bp, Artificial Sequence
  Synthetic
gccaagcatttaggtgacactatagcacagagaagtggtcgtcatgtttcagagctatgctggaaacagc

SEQ ID NO: 63691 - DNA, 70 bp, Artificial Sequence
  Synthetic
gccaagcatttaggtgacactatagcctgccccactgctgaatgagtttcagagctatgctggaaacagc

SEQ ID NO: 63692 - DNA, 70 bp, Artificial Sequence
  Synthetic
gccaagcatttaggtgacactataggcttatccgagagaaagatggtttcagagctatgctggaaacagc

SEQ ID NO: 63693 - DNA, 70 bp, Artificial Sequence
  Synthetic
gccaagcatttaggtgacactatagaacctgtgaccacctgctaggtttcagagctatgctggaaacagc

SEQ ID NO: 63694 - DNA, 70 bp, Artificial Sequence
  Synthetic
gccaagcatttaggtgacactataggtgtccgcggcgagcgtcacgtttcagagctatgctggaaacagc

SEQ ID NO: 63695 - DNA, 70 bp, Artificial Sequence
  Synthetic
gccaagcatttaggtgacactatagcctgataagcttctcagtctgtttcagagctatgctggaaacagc

SEQ ID NO: 63696 - DNA, 70 bp, Artificial Sequence
  Synthetic
gccaagcatttaggtgacactatagtactattcagtacacagccagtttcagagctatgctggaaacagc

SEQ ID NO: 63697 - DNA, 70 bp, Artificial Sequence
  Synthetic
gccaagcatttaggtgacactatagtcccagggctcccaggctgggtttcagagctatgctggaaacagc

SEQ ID NO: 63698 - DNA, 70 bp, Artificial Sequence
  Synthetic
gccaagcatttaggtgacactatagcgaggatgagaaagcaaactgtttcagagctatgctggaaacagc

SEQ ID NO: 63699 - DNA, 70 bp, Artificial Sequence
  Synthetic
gccaagcatttaggtgacactatagacagtgtcactattccctgagtttcagagctatgctggaaacagc

SEQ ID NO: 63700 - DNA, 70 bp, Artificial Sequence
  Synthetic
gccaagcatttaggtgacactataggcagcccctgaggaaggacagtttcagagctatgctggaaacagc

SEQ ID NO: 63701 - DNA, 70 bp, Artificial Sequence
  Synthetic
gccaagcatttaggtgacactatagtgttggagctgctgcctcaggtttcagagctatgctggaaacagc

SEQ ID NO: 63702 - DNA, 70 bp, Artificial Sequence
  Synthetic
gccaagcatttaggtgacactatagcagggtggcgtctacatctcgtttcagagctatgctggaaacagc

SEQ ID NO: 63703 - DNA, 70 bp, Artificial Sequence
  Synthetic
gccaagcatttaggtgacactatagagcacaactgttagttttcagtttcagagctatgctggaaacagc

SEQ ID NO: 63704 - DNA, 70 bp, Artificial Sequence
  Synthetic
gccaagcatttaggtgacactatagattcccagctctggcttaacgtttcagagctatgctggaaacagc

SEQ ID NO: 63705 - DNA, 70 bp, Artificial Sequence
  Synthetic
gccaagcatttaggtgacactataggatcatgcaagaaaagcagagtttcagagctatgctggaaacagc

SEQ ID NO: 63706 - DNA, 70 bp, Artificial Sequence
  Synthetic
gccaagcatttaggtgacactatagggacttttgctgttggatttgtttcagagctatgctggaaacagc

SEQ ID NO: 63707 - DNA, 70 bp, Artificial Sequence
  Synthetic
gccaagcatttaggtgacactatagggccactcccgggggtgagggtttcagagctatgctggaaacagc

SEQ ID NO: 63708 - DNA, 70 bp, Artificial Sequence
  Synthetic
gccaagcatttaggtgacactatagtctgactggtccagaaatgggtttcagagctatgctggaaacagc

SEQ ID NO: 63709 - DNA, 70 bp, Artificial Sequence
  Synthetic
gccaagcatttaggtgacactatagtccaggcccagagctacagcgtttcagagctatgctggaaacagc

SEQ ID NO: 63710 - DNA, 70 bp, Artificial Sequence
  Synthetic
gccaagcatttaggtgacactatagtcacgatttgtaagaacaaggtttcagagctatgctggaaacagc

SEQ ID NO: 63711 - DNA, 70 bp, Artificial Sequence
  Synthetic
gccaagcatttaggtgacactatagcgcaaccgcgacttcagctggtttcagagctatgctggaaacagc

SEQ ID NO: 63712 - DNA, 70 bp, Artificial Sequence
  Synthetic
gccaagcatttaggtgacactatagggttcagctgaagtcccgacgtttcagagctatgctggaaacagc

SEQ ID NO: 63713 - DNA, 70 bp, Artificial Sequence
  Synthetic
gccaagcatttaggtgacactatagtttgtgaaaaggacttagacgtttcagagctatgctggaaacagc

SEQ ID NO: 63714 - DNA, 70 bp, Artificial Sequence
  Synthetic
gccaagcatttaggtgacactatagatcatcacacagagaactccgtttcagagctatgctggaaacagc

SEQ ID NO: 63715 - DNA, 70 bp, Artificial Sequence
  Synthetic
gccaagcatttaggtgacactatagtgatgatgaccgtcaccaacgtttcagagctatgctggaaacagc

SEQ ID NO: 63716 - DNA, 70 bp, Artificial Sequence
  Synthetic
gccaagcatttaggtgacactataggtctgtaggaccctggttatgtttcagagctatgctggaaacagc

SEQ ID NO: 63717 - DNA, 70 bp, Artificial Sequence
  Synthetic
gccaagcatttaggtgacactataggtggccctctgaacgatcacgtttcagagctatgctggaaacagc

SEQ ID NO: 63718 - DNA, 70 bp, Artificial Sequence
  Synthetic
gccaagcatttaggtgacactataggagcgagaggcagttattttgtttcagagctatgctggaaacagc

SEQ ID NO: 63719 - DNA, 70 bp, Artificial Sequence
  Synthetic
gccaagcatttaggtgacactatagttatgcgtgtcctgaattatgtttcagagctatgctggaaacagc

SEQ ID NO: 63720 - DNA, 70 bp, Artificial Sequence
  Synthetic
gccaagcatttaggtgacactatagaagttgtcaacccagttgcagtttcagagctatgctggaaacagc

SEQ ID NO: 63721 - DNA, 70 bp, Artificial Sequence
  Synthetic
gccaagcatttaggtgacactatagtagggttaacaatctttcccgtttcagagctatgctggaaacagc

SEQ ID NO: 63722 - DNA, 70 bp, Artificial Sequence
  Synthetic
gccaagcatttaggtgacactataggaatcccacccaaaaataacgtttcagagctatgctggaaacagc

SEQ ID NO: 63723 - DNA, 70 bp, Artificial Sequence
  Synthetic
gccaagcatttaggtgacactatagtggcaagctctaggcttgctgtttcagagctatgctggaaacagc

SEQ ID NO: 63724 - DNA, 70 bp, Artificial Sequence
  Synthetic
gccaagcatttaggtgacactatagctgggagggctatggtttcggtttcagagctatgctggaaacagc

SEQ ID NO: 63725 - DNA, 70 bp, Artificial Sequence
  Synthetic
gccaagcatttaggtgacactatagaaagtgaaccgcccctgagggtttcagagctatgctggaaacagc

SEQ ID NO: 63726 - DNA, 70 bp, Artificial Sequence
  Synthetic
gccaagcatttaggtgacactataggggtgggtggtctcttacacgtttcagagctatgctggaaacagc

SEQ ID NO: 63727 - DNA, 70 bp, Artificial Sequence
  Synthetic
gccaagcatttaggtgacactatagaacccaacggaagcgtagttgtttcagagctatgctggaaacagc

SEQ ID NO: 63728 - DNA, 70 bp, Artificial Sequence
  Synthetic
gccaagcatttaggtgacactatagaatcccactaaatcctaggtgtttcagagctatgctggaaacagc

SEQ ID NO: 63729 - DNA, 70 bp, Artificial Sequence
  Synthetic
gccaagcatttaggtgacactatagtacagtctctttcttctaaggtttcagagctatgctggaaacagc

SEQ ID NO: 63730 - DNA, 70 bp, Artificial Sequence
  Synthetic
gccaagcatttaggtgacactataggagagatatgcaggatttaggtttcagagctatgctggaaacagc

SEQ ID NO: 63731 - DNA, 70 bp, Artificial Sequence
  Synthetic
gccaagcatttaggtgacactatagaaccccatctgattagggaggtttcagagctatgctggaaacagc

SEQ ID NO: 63732 - DNA, 70 bp, Artificial Sequence
  Synthetic
gccaagcatttaggtgacactatagagggtctgctctccttaaaagtttcagagctatgctggaaacagc

SEQ ID NO: 63733 - DNA, 70 bp, Artificial Sequence
  Synthetic
gccaagcatttaggtgacactatagtccaacagcatcctcttcttgtttcagagctatgctggaaacagc

SEQ ID NO: 63734 - DNA, 70 bp, Artificial Sequence
  Synthetic
gccaagcatttaggtgacactataggcacgcttagttttagggtggtttcagagctatgctggaaacagc

SEQ ID NO: 63735 - DNA, 70 bp, Artificial Sequence
  Synthetic
gccaagcatttaggtgacactataggacagactaattgcatctacgtttcagagctatgctggaaacagc

SEQ ID NO: 63736 - DNA, 70 bp, Artificial Sequence
  Synthetic
gccaagcatttaggtgacactatagacagactaattgcatctatggtttcagagctatgctggaaacagc

SEQ ID NO: 63737 - DNA, 70 bp, Artificial Sequence
  Synthetic
gccaagcatttaggtgacactatagagcacggatcctgcagcacagtttcagagctatgctggaaacagc

SEQ ID NO: 63738 - DNA, 70 bp, Artificial Sequence
  Synthetic
gccaagcatttaggtgacactatagggccgcttttcctctccgtggtttcagagctatgctggaaacagc

SEQ ID NO: 63739 - DNA, 70 bp, Artificial Sequence
  Synthetic
gccaagcatttaggtgacactatagacccattcctatttgttatcgtttcagagctatgctggaaacagc

SEQ ID NO: 63740 - DNA, 70 bp, Artificial Sequence
  Synthetic
gccaagcatttaggtgacactatagaggttctcttctccgtaaaggtttcagagctatgctggaaacagc

SEQ ID NO: 63741 - DNA, 70 bp, Artificial Sequence
  Synthetic
gccaagcatttaggtgacactataggctggaggagagttatgactgtttcagagctatgctggaaacagc

SEQ ID NO: 63742 - DNA, 70 bp, Artificial Sequence
  Synthetic
gccaagcatttaggtgacactatagtctgcttcccgatgacaacagtttcagagctatgctggaaacagc

SEQ ID NO: 63743 - DNA, 70 bp, Artificial Sequence
  Synthetic
gccaagcatttaggtgacactatagtgacaacacggacctcgccggtttcagagctatgctggaaacagc

SEQ ID NO: 63744 - DNA, 70 bp, Artificial Sequence
  Synthetic
gccaagcatttaggtgacactatagcaggttctcatcgccataaagtttcagagctatgctggaaacagc

SEQ ID NO: 63745 - DNA, 70 bp, Artificial Sequence
  Synthetic
gccaagcatttaggtgacactatagcaaggccaacaggcctttccgtttcagagctatgctggaaacagc

SEQ ID NO: 63746 - DNA, 70 bp, Artificial Sequence
  Synthetic
gccaagcatttaggtgacactatagccaaccccagcaggtcctaggtttcagagctatgctggaaacagc

SEQ ID NO: 63747 - DNA, 70 bp, Artificial Sequence
  Synthetic
gccaagcatttaggtgacactatagagggtcagggttccatcactgtttcagagctatgctggaaacagc

SEQ ID NO: 63748 - DNA, 70 bp, Artificial Sequence
  Synthetic
gccaagcatttaggtgacactatagttcatccgacataatcctacgtttcagagctatgctggaaacagc

SEQ ID NO: 63749 - DNA, 70 bp, Artificial Sequence
  Synthetic
gccaagcatttaggtgacactataggcttatttttgaggggataggtttcagagctatgctggaaacagc

SEQ ID NO: 63750 - DNA, 70 bp, Artificial Sequence
  Synthetic
gccaagcatttaggtgacactatagactgggatattaggggccccgtttcagagctatgctggaaacagc

SEQ ID NO: 63751 - DNA, 70 bp, Artificial Sequence
  Synthetic
gccaagcatttaggtgacactataggtttggcagccccaagtgaggtttcagagctatgctggaaacagc

SEQ ID NO: 63752 - DNA, 70 bp, Artificial Sequence
  Synthetic
gccaagcatttaggtgacactatagatcctgcaggtctcaggcccgtttcagagctatgctggaaacagc

SEQ ID NO: 63753 - DNA, 70 bp, Artificial Sequence
  Synthetic
gccaagcatttaggtgacactatagaagatgcgagacgagttatagtttcagagctatgctggaaacagc

SEQ ID NO: 63754 - DNA, 70 bp, Artificial Sequence
  Synthetic
gccaagcatttaggtgacactatagcctgaaacaatgaacacaaggtttcagagctatgctggaaacagc

SEQ ID NO: 63755 - DNA, 70 bp, Artificial Sequence
  Synthetic
gccaagcatttaggtgacactatagcctgacacccaggagataaagtttcagagctatgctggaaacagc

SEQ ID NO: 63756 - DNA, 70 bp, Artificial Sequence
  Synthetic
gccaagcatttaggtgacactatagagcacgagggctcagcgcccgtttcagagctatgctggaaacagc

SEQ ID NO: 63757 - DNA, 70 bp, Artificial Sequence
  Synthetic
gccaagcatttaggtgacactatagacatcatggaggtgcttgttgtttcagagctatgctggaaacagc

SEQ ID NO: 63758 - DNA, 70 bp, Artificial Sequence
  Synthetic
gccaagcatttaggtgacactatagacatcatggaaatcattctggtttcagagctatgctggaaacagc

SEQ ID NO: 63759 - DNA, 70 bp, Artificial Sequence
  Synthetic
gccaagcatttaggtgacactatagaacaaactgtgctgcagcaagtttcagagctatgctggaaacagc

SEQ ID NO: 63760 - DNA, 70 bp, Artificial Sequence
  Synthetic
gccaagcatttaggtgacactataggattcctatgtgatgcagctgtttcagagctatgctggaaacagc

SEQ ID NO: 63761 - DNA, 70 bp, Artificial Sequence
  Synthetic
gccaagcatttaggtgacactatagttttcaaacctttcatcctggtttcagagctatgctggaaacagc

SEQ ID NO: 63762 - DNA, 70 bp, Artificial Sequence
  Synthetic
gccaagcatttaggtgacactatagaaaggcatcaggtcatataggtttcagagctatgctggaaacagc

SEQ ID NO: 63763 - DNA, 70 bp, Artificial Sequence
  Synthetic
gccaagcatttaggtgacactatagtcaggagtcaggtcatgtaggtttcagagctatgctggaaacagc

SEQ ID NO: 63764 - DNA, 70 bp, Artificial Sequence
  Synthetic
gccaagcatttaggtgacactatagtcaggtcaaatgccgagttagtttcagagctatgctggaaacagc

SEQ ID NO: 63765 - DNA, 70 bp, Artificial Sequence
  Synthetic
gccaagcatttaggtgacactatagtggtagctattagctctctggtttcagagctatgctggaaacagc

SEQ ID NO: 63766 - DNA, 70 bp, Artificial Sequence
  Synthetic
gccaagcatttaggtgacactatagagcgaggtccttccctaggggtttcagagctatgctggaaacagc

SEQ ID NO: 63767 - DNA, 70 bp, Artificial Sequence
  Synthetic
gccaagcatttaggtgacactatagtcacagtgaacctgcagtctgtttcagagctatgctggaaacagc

SEQ ID NO: 63768 - DNA, 70 bp, Artificial Sequence
  Synthetic
gccaagcatttaggtgacactatagcggggctccctaaactgagggtttcagagctatgctggaaacagc

SEQ ID NO: 63769 - DNA, 70 bp, Artificial Sequence
  Synthetic
gccaagcatttaggtgacactatagctggtgccggggcctagttggtttcagagctatgctggaaacagc

SEQ ID NO: 63770 - DNA, 70 bp, Artificial Sequence
  Synthetic
gccaagcatttaggtgacactatagctctaattcagtgtcctcttgtttcagagctatgctggaaacagc

SEQ ID NO: 63771 - DNA, 70 bp, Artificial Sequence
  Synthetic
gccaagcatttaggtgacactatagagacagcactgctggagttagtttcagagctatgctggaaacagc

SEQ ID NO: 63772 - DNA, 70 bp, Artificial Sequence
  Synthetic
gccaagcatttaggtgacactataggaatggagggtcttaggcaggtttcagagctatgctggaaacagc

SEQ ID NO: 63773 - DNA, 70 bp, Artificial Sequence
  Synthetic
gccaagcatttaggtgacactatagaagctgtttgcaaactgtgcgtttcagagctatgctggaaacagc

SEQ ID NO: 63774 - DNA, 70 bp, Artificial Sequence
  Synthetic
gccaagcatttaggtgacactataggtgtttatgtctcaagaggtgtttcagagctatgctggaaacagc

SEQ ID NO: 63775 - DNA, 70 bp, Artificial Sequence
  Synthetic
gccaagcatttaggtgacactatagactcagacgggactttcctagtttcagagctatgctggaaacagc

SEQ ID NO: 63776 - DNA, 70 bp, Artificial Sequence
  Synthetic
gccaagcatttaggtgacactatagcaagccttacaggttcgctagtttcagagctatgctggaaacagc

SEQ ID NO: 63777 - DNA, 70 bp, Artificial Sequence
  Synthetic
gccaagcatttaggtgacactatagcgtgtgactgttcactctgcgtttcagagctatgctggaaacagc

SEQ ID NO: 63778 - DNA, 70 bp, Artificial Sequence
  Synthetic
gccaagcatttaggtgacactatagggccacccagcaaaagtgaagtttcagagctatgctggaaacagc

SEQ ID NO: 63779 - DNA, 70 bp, Artificial Sequence
  Synthetic
gccaagcatttaggtgacactatagtcattatgagcatcagtcctgtttcagagctatgctggaaacagc

SEQ ID NO: 63780 - DNA, 70 bp, Artificial Sequence
  Synthetic
gccaagcatttaggtgacactataggcacttagggacatcaatcagtttcagagctatgctggaaacagc

SEQ ID NO: 63781 - DNA, 70 bp, Artificial Sequence
  Synthetic
gccaagcatttaggtgacactatagaatggtaagaaggcatcatggtttcagagctatgctggaaacagc

SEQ ID NO: 63782 - DNA, 70 bp, Artificial Sequence
  Synthetic
gccaagcatttaggtgacactatagcctacagctatgacaaacaagtttcagagctatgctggaaacagc

SEQ ID NO: 63783 - DNA, 70 bp, Artificial Sequence
  Synthetic
gccaagcatttaggtgacactataggcagaggacgtcttctttaggtttcagagctatgctggaaacagc

SEQ ID NO: 63784 - DNA, 70 bp, Artificial Sequence
  Synthetic
gccaagcatttaggtgacactatagctctacaattttggaggcaggtttcagagctatgctggaaacagc

SEQ ID NO: 63785 - DNA, 70 bp, Artificial Sequence
  Synthetic
gccaagcatttaggtgacactatagggaaatcttctgccaatgtggtttcagagctatgctggaaacagc

SEQ ID NO: 63786 - DNA, 70 bp, Artificial Sequence
  Synthetic
gccaagcatttaggtgacactatagaaacttatgtaactaggcaggtttcagagctatgctggaaacagc

SEQ ID NO: 63787 - DNA, 70 bp, Artificial Sequence
  Synthetic
gccaagcatttaggtgacactatagtttgccaacgagaaataagtgtttcagagctatgctggaaacagc

SEQ ID NO: 63788 - DNA, 70 bp, Artificial Sequence
  Synthetic
gccaagcatttaggtgacactataggaggaaggagaggaggatgagtttcagagctatgctggaaacagc

SEQ ID NO: 63789 - DNA, 70 bp, Artificial Sequence
  Synthetic
gccaagcatttaggtgacactatagcaagaggacactggagcagggtttcagagctatgctggaaacagc

SEQ ID NO: 63790 - DNA, 70 bp, Artificial Sequence
  Synthetic
gccaagcatttaggtgacactatagtatgaagtctccatctaggtgtttcagagctatgctggaaacagc

SEQ ID NO: 63791 - DNA, 70 bp, Artificial Sequence
  Synthetic
gccaagcatttaggtgacactatagtattctctcgtctcctgcaagtttcagagctatgctggaaacagc

SEQ ID NO: 63792 - DNA, 70 bp, Artificial Sequence
  Synthetic
gccaagcatttaggtgacactataggatagaaacctcatactctcgtttcagagctatgctggaaacagc

SEQ ID NO: 63793 - DNA, 70 bp, Artificial Sequence
  Synthetic
gccaagcatttaggtgacactatagctgtagtcttggggttcagagtttcagagctatgctggaaacagc

SEQ ID NO: 63794 - DNA, 70 bp, Artificial Sequence
  Synthetic
gccaagcatttaggtgacactatagccctggtggacaggatggttgtttcagagctatgctggaaacagc

SEQ ID NO: 63795 - DNA, 70 bp, Artificial Sequence
  Synthetic
gccaagcatttaggtgacactatagctgcctggaagggtcaccaagtttcagagctatgctggaaacagc

SEQ ID NO: 63796 - DNA, 70 bp, Artificial Sequence
  Synthetic
gccaagcatttaggtgacactatagatcatggtgacaaagttagagtttcagagctatgctggaaacagc

SEQ ID NO: 63797 - DNA, 70 bp, Artificial Sequence
  Synthetic
gccaagcatttaggtgacactatagaaacaagtctagttctgtgggtttcagagctatgctggaaacagc

SEQ ID NO: 63798 - DNA, 70 bp, Artificial Sequence
  Synthetic
gccaagcatttaggtgacactatagccctcaaggagagaggcggggtttcagagctatgctggaaacagc

SEQ ID NO: 63799 - DNA, 70 bp, Artificial Sequence
  Synthetic
gccaagcatttaggtgacactatagggagggagcagcttctcagtgtttcagagctatgctggaaacagc

SEQ ID NO: 63800 - DNA, 70 bp, Artificial Sequence
  Synthetic
gccaagcatttaggtgacactatagtacgaggatctgaaaagacagtttcagagctatgctggaaacagc

SEQ ID NO: 63801 - DNA, 70 bp, Artificial Sequence
  Synthetic
gccaagcatttaggtgacactatagaatgtgctatgagagcgtccgtttcagagctatgctggaaacagc

SEQ ID NO: 63802 - DNA, 70 bp, Artificial Sequence
  Synthetic
gccaagcatttaggtgacactatagcgtcttgatccttttgcagagtttcagagctatgctggaaacagc

SEQ ID NO: 63803 - DNA, 70 bp, Artificial Sequence
  Synthetic
gccaagcatttaggtgacactatagtgggggcagcaagaaatatagtttcagagctatgctggaaacagc

SEQ ID NO: 63804 - DNA, 70 bp, Artificial Sequence
  Synthetic
gccaagcatttaggtgacactatagccgggaaaggagggctcagagtttcagagctatgctggaaacagc

SEQ ID NO: 63805 - DNA, 70 bp, Artificial Sequence
  Synthetic
gccaagcatttaggtgacactatagatgtgaatttactgagggaggtttcagagctatgctggaaacagc

SEQ ID NO: 63806 - DNA, 70 bp, Artificial Sequence
  Synthetic
gccaagcatttaggtgacactatagggcagagtctcagttctcctgtttcagagctatgctggaaacagc

SEQ ID NO: 63807 - DNA, 70 bp, Artificial Sequence
  Synthetic
gccaagcatttaggtgacactatagaagcttctcaaggagaaatagtttcagagctatgctggaaacagc

SEQ ID NO: 63808 - DNA, 70 bp, Artificial Sequence
  Synthetic
gccaagcatttaggtgacactatagtggtgcgaacacgctagcacgtttcagagctatgctggaaacagc

SEQ ID NO: 63809 - DNA, 70 bp, Artificial Sequence
  Synthetic
gccaagcatttaggtgacactataggagcagtttgccaactgagagtttcagagctatgctggaaacagc

SEQ ID NO: 63810 - DNA, 70 bp, Artificial Sequence
  Synthetic
gccaagcatttaggtgacactatagctcccgagggcagactcagtgtttcagagctatgctggaaacagc

SEQ ID NO: 63811 - DNA, 70 bp, Artificial Sequence
  Synthetic
gccaagcatttaggtgacactatagtggcgggcaacactcagctcgtttcagagctatgctggaaacagc

SEQ ID NO: 63812 - DNA, 70 bp, Artificial Sequence
  Synthetic
gccaagcatttaggtgacactatagagagggagagaagagtacgagtttcagagctatgctggaaacagc

SEQ ID NO: 63813 - DNA, 70 bp, Artificial Sequence
  Synthetic
gccaagcatttaggtgacactatagactcaattgatagaccactagtttcagagctatgctggaaacagc

SEQ ID NO: 63814 - DNA, 70 bp, Artificial Sequence
  Synthetic
gccaagcatttaggtgacactatagccgggagaatcacttaaacagtttcagagctatgctggaaacagc

SEQ ID NO: 63815 - DNA, 70 bp, Artificial Sequence
  Synthetic
gccaagcatttaggtgacactataggggactagcactgcagcttggtttcagagctatgctggaaacagc

SEQ ID NO: 63816 - DNA, 70 bp, Artificial Sequence
  Synthetic
gccaagcatttaggtgacactatagtagttagctcacactcttttgtttcagagctatgctggaaacagc

SEQ ID NO: 63817 - DNA, 70 bp, Artificial Sequence
  Synthetic
gccaagcatttaggtgacactatagcaaggaggagtgcccttcaggtttcagagctatgctggaaacagc

SEQ ID NO: 63818 - DNA, 70 bp, Artificial Sequence
  Synthetic
gccaagcatttaggtgacactatagcaaaccagcgcttcctgagagtttcagagctatgctggaaacagc

SEQ ID NO: 63819 - DNA, 70 bp, Artificial Sequence
  Synthetic
gccaagcatttaggtgacactatagtgtcgtacatcccatatgcagtttcagagctatgctggaaacagc

SEQ ID NO: 63820 - DNA, 70 bp, Artificial Sequence
  Synthetic
gccaagcatttaggtgacactatagtttccttcataccatttgcagtttcagagctatgctggaaacagc

SEQ ID NO: 63821 - DNA, 70 bp, Artificial Sequence
  Synthetic
gccaagcatttaggtgacactataggagggcgcgaggtcctcacagtttcagagctatgctggaaacagc

SEQ ID NO: 63822 - DNA, 70 bp, Artificial Sequence
  Synthetic
gccaagcatttaggtgacactataggtcatgtgttgcagacaacagtttcagagctatgctggaaacagc

SEQ ID NO: 63823 - DNA, 70 bp, Artificial Sequence
  Synthetic
gccaagcatttaggtgacactatagacaaagcaggagttcatccggtttcagagctatgctggaaacagc

SEQ ID NO: 63824 - DNA, 70 bp, Artificial Sequence
  Synthetic
gccaagcatttaggtgacactatagcacagaatttatacagcagcgtttcagagctatgctggaaacagc

SEQ ID NO: 63825 - DNA, 70 bp, Artificial Sequence
  Synthetic
gccaagcatttaggtgacactatagggtgtgggagatgtgccaaggtttcagagctatgctggaaacagc

SEQ ID NO: 63826 - DNA, 70 bp, Artificial Sequence
  Synthetic
gccaagcatttaggtgacactataggaccatctgtgagttctgaggtttcagagctatgctggaaacagc

SEQ ID NO: 63827 - DNA, 70 bp, Artificial Sequence
  Synthetic
gccaagcatttaggtgacactataggacagctgagttctcatcaagtttcagagctatgctggaaacagc

SEQ ID NO: 63828 - DNA, 70 bp, Artificial Sequence
  Synthetic
gccaagcatttaggtgacactatagggtgccgctctactacatctgtttcagagctatgctggaaacagc

SEQ ID NO: 63829 - DNA, 70 bp, Artificial Sequence
  Synthetic
gccaagcatttaggtgacactatagttgtggagaaaagcgtcttggtttcagagctatgctggaaacagc

SEQ ID NO: 63830 - DNA, 70 bp, Artificial Sequence
  Synthetic
gccaagcatttaggtgacactatagcgacgcgtgtacttcaataagtttcagagctatgctggaaacagc

SEQ ID NO: 63831 - DNA, 70 bp, Artificial Sequence
  Synthetic
gccaagcatttaggtgacactatagagcccctggcatgggttagcgtttcagagctatgctggaaacagc

SEQ ID NO: 63832 - DNA, 70 bp, Artificial Sequence
  Synthetic
gccaagcatttaggtgacactatagttggatcttagcttgcaactgtttcagagctatgctggaaacagc

SEQ ID NO: 63833 - DNA, 70 bp, Artificial Sequence
  Synthetic
gccaagcatttaggtgacactatagaggctcaagttctccatactgtttcagagctatgctggaaacagc

SEQ ID NO: 63834 - DNA, 70 bp, Artificial Sequence
  Synthetic
gccaagcatttaggtgacactatagtacaacaaggggctttgagggtttcagagctatgctggaaacagc

SEQ ID NO: 63835 - DNA, 70 bp, Artificial Sequence
  Synthetic
gccaagcatttaggtgacactatagcttttatcacagaggggtgtgtttcagagctatgctggaaacagc

SEQ ID NO: 63836 - DNA, 70 bp, Artificial Sequence
  Synthetic
gccaagcatttaggtgacactatagggacagtggtgtacaacaaggtttcagagctatgctggaaacagc

SEQ ID NO: 63837 - DNA, 70 bp, Artificial Sequence
  Synthetic
gccaagcatttaggtgacactatagaggaggggctgtctccagaggtttcagagctatgctggaaacagc

SEQ ID NO: 63838 - DNA, 70 bp, Artificial Sequence
  Synthetic
gccaagcatttaggtgacactataggggctatctccggctctaatgtttcagagctatgctggaaacagc

SEQ ID NO: 63839 - DNA, 70 bp, Artificial Sequence
  Synthetic
gccaagcatttaggtgacactatagggtacggggagctggaggaagtttcagagctatgctggaaacagc

SEQ ID NO: 63840 - DNA, 70 bp, Artificial Sequence
  Synthetic
gccaagcatttaggtgacactataggtcagtgctggtccagaatggtttcagagctatgctggaaacagc

SEQ ID NO: 63841 - DNA, 70 bp, Artificial Sequence
  Synthetic
gccaagcatttaggtgacactatagtttaatgagtgtttccacaggtttcagagctatgctggaaacagc

SEQ ID NO: 63842 - DNA, 70 bp, Artificial Sequence
  Synthetic
gccaagcatttaggtgacactatagactccgaggtcaaccagttagtttcagagctatgctggaaacagc

SEQ ID NO: 63843 - DNA, 70 bp, Artificial Sequence
  Synthetic
gccaagcatttaggtgacactatagcactatggatagtctttcaggtttcagagctatgctggaaacagc

SEQ ID NO: 63844 - DNA, 70 bp, Artificial Sequence
  Synthetic
gccaagcatttaggtgacactatagattccccaacagcagactacgtttcagagctatgctggaaacagc

SEQ ID NO: 63845 - DNA, 70 bp, Artificial Sequence
  Synthetic
gccaagcatttaggtgacactatagagaggacgcaggcagctcaggtttcagagctatgctggaaacagc

SEQ ID NO: 63846 - DNA, 70 bp, Artificial Sequence
  Synthetic
gccaagcatttaggtgacactatagatcagtcacttcagctccacgtttcagagctatgctggaaacagc

SEQ ID NO: 63847 - DNA, 70 bp, Artificial Sequence
  Synthetic
gccaagcatttaggtgacactatagcaggcggcatcactttttctgtttcagagctatgctggaaacagc

SEQ ID NO: 63848 - DNA, 70 bp, Artificial Sequence
  Synthetic
gccaagcatttaggtgacactatagatcaagaaaaggtttgctgcgtttcagagctatgctggaaacagc

SEQ ID NO: 63849 - DNA, 70 bp, Artificial Sequence
  Synthetic
gccaagcatttaggtgacactatagcaagccctaacagggttcaggtttcagagctatgctggaaacagc

SEQ ID NO: 63850 - DNA, 70 bp, Artificial Sequence
  Synthetic
gccaagcatttaggtgacactataggccagaggatgatgacatctgtttcagagctatgctggaaacagc

SEQ ID NO: 63851 - DNA, 70 bp, Artificial Sequence
  Synthetic
gccaagcatttaggtgacactataggaggcagatgatgcattcgtgtttcagagctatgctggaaacagc

SEQ ID NO: 63852 - DNA, 70 bp, Artificial Sequence
  Synthetic
gccaagcatttaggtgacactatagtacagtagagaggctcaagcgtttcagagctatgctggaaacagc

SEQ ID NO: 63853 - DNA, 70 bp, Artificial Sequence
  Synthetic
gccaagcatttaggtgacactataggttatgtgtcattcaccagcgtttcagagctatgctggaaacagc

SEQ ID NO: 63854 - DNA, 70 bp, Artificial Sequence
  Synthetic
gccaagcatttaggtgacactataggacaatgagaaatcgacctggtttcagagctatgctggaaacagc

SEQ ID NO: 63855 - DNA, 70 bp, Artificial Sequence
  Synthetic
gccaagcatttaggtgacactatagcacagccagcgtgaactatagtttcagagctatgctggaaacagc

SEQ ID NO: 63856 - DNA, 70 bp, Artificial Sequence
  Synthetic
gccaagcatttaggtgacactatagttgaaacccacatctgcttggtttcagagctatgctggaaacagc

SEQ ID NO: 63857 - DNA, 70 bp, Artificial Sequence
  Synthetic
gccaagcatttaggtgacactatagaacggacaagcagaagaagagtttcagagctatgctggaaacagc

SEQ ID NO: 63858 - DNA, 70 bp, Artificial Sequence
  Synthetic
gccaagcatttaggtgacactatagtagaaagggtccaagttcaggtttcagagctatgctggaaacagc

SEQ ID NO: 63859 - DNA, 70 bp, Artificial Sequence
  Synthetic
gccaagcatttaggtgacactatagtcggtatattacctatggaagtttcagagctatgctggaaacagc

SEQ ID NO: 63860 - DNA, 70 bp, Artificial Sequence
  Synthetic
gccaagcatttaggtgacactatagccgatgcttcacaggtttctgtttcagagctatgctggaaacagc

SEQ ID NO: 63861 - DNA, 70 bp, Artificial Sequence
  Synthetic
gccaagcatttaggtgacactatagagaggtgaagtaagctgctcgtttcagagctatgctggaaacagc

SEQ ID NO: 63862 - DNA, 70 bp, Artificial Sequence
  Synthetic
gccaagcatttaggtgacactataggggatggtcacagctcattggtttcagagctatgctggaaacagc

SEQ ID NO: 63863 - DNA, 70 bp, Artificial Sequence
  Synthetic
gccaagcatttaggtgacactataggggcagctcctgtgtgctgagtttcagagctatgctggaaacagc

SEQ ID NO: 63864 - DNA, 70 bp, Artificial Sequence
  Synthetic
gccaagcatttaggtgacactatagtctgattgagaacaagtgaggtttcagagctatgctggaaacagc

SEQ ID NO: 63865 - DNA, 70 bp, Artificial Sequence
  Synthetic
gccaagcatttaggtgacactatagaaagcatcacttcttacacggtttcagagctatgctggaaacagc

SEQ ID NO: 63866 - DNA, 70 bp, Artificial Sequence
  Synthetic
gccaagcatttaggtgacactatagctcatagagaacaagtgagcgtttcagagctatgctggaaacagc

SEQ ID NO: 63867 - DNA, 70 bp, Artificial Sequence
  Synthetic
gccaagcatttaggtgacactatagaggttctgcccttccttgaggtttcagagctatgctggaaacagc

SEQ ID NO: 63868 - DNA, 70 bp, Artificial Sequence
  Synthetic
gccaagcatttaggtgacactatagtcttcagctgggatgtggacgtttcagagctatgctggaaacagc

SEQ ID NO: 63869 - DNA, 70 bp, Artificial Sequence
  Synthetic
gccaagcatttaggtgacactatagcgccagcaacgacgaccagcgtttcagagctatgctggaaacagc

SEQ ID NO: 63870 - DNA, 70 bp, Artificial Sequence
  Synthetic
gccaagcatttaggtgacactatagtgctgctgaatgatctgctcgtttcagagctatgctggaaacagc

SEQ ID NO: 63871 - DNA, 70 bp, Artificial Sequence
  Synthetic
gccaagcatttaggtgacactatagacacagtcactcgctccgaagtttcagagctatgctggaaacagc

SEQ ID NO: 63872 - DNA, 70 bp, Artificial Sequence
  Synthetic
gccaagcatttaggtgacactatagagggggctggggtgggtcatgtttcagagctatgctggaaacagc

SEQ ID NO: 63873 - DNA, 70 bp, Artificial Sequence
  Synthetic
gccaagcatttaggtgacactatagggtggggttggctcacacgagtttcagagctatgctggaaacagc

SEQ ID NO: 63874 - DNA, 70 bp, Artificial Sequence
  Synthetic
gccaagcatttaggtgacactatagcggcgccgcgggctagtagagtttcagagctatgctggaaacagc

SEQ ID NO: 63875 - DNA, 70 bp, Artificial Sequence
  Synthetic
gccaagcatttaggtgacactataggaattcctcactggtcagaggtttcagagctatgctggaaacagc

SEQ ID NO: 63876 - DNA, 70 bp, Artificial Sequence
  Synthetic
gccaagcatttaggtgacactatagtttttcttcatggggctttcgtttcagagctatgctggaaacagc

SEQ ID NO: 63877 - DNA, 70 bp, Artificial Sequence
  Synthetic
gccaagcatttaggtgacactataggaacagtaacagcgattatggtttcagagctatgctggaaacagc

SEQ ID NO: 63878 - DNA, 70 bp, Artificial Sequence
  Synthetic
gccaagcatttaggtgacactatagccttgggcctcctcagtagggtttcagagctatgctggaaacagc

SEQ ID NO: 63879 - DNA, 70 bp, Artificial Sequence
  Synthetic
gccaagcatttaggtgacactatagaagggtgtctgcgctctcaggtttcagagctatgctggaaacagc

SEQ ID NO: 63880 - DNA, 70 bp, Artificial Sequence
  Synthetic
gccaagcatttaggtgacactatagtccctggggtcacagctcgcgtttcagagctatgctggaaacagc

SEQ ID NO: 63881 - DNA, 70 bp, Artificial Sequence
  Synthetic
gccaagcatttaggtgacactataggctgtcactcaaacagctccgtttcagagctatgctggaaacagc

SEQ ID NO: 63882 - DNA, 70 bp, Artificial Sequence
  Synthetic
gccaagcatttaggtgacactatagtcaaacaacagatggtagtcgtttcagagctatgctggaaacagc

SEQ ID NO: 63883 - DNA, 70 bp, Artificial Sequence
  Synthetic
gccaagcatttaggtgacactataggctgcagggcctgggctaaggtttcagagctatgctggaaacagc

SEQ ID NO: 63884 - DNA, 70 bp, Artificial Sequence
  Synthetic
gccaagcatttaggtgacactatagcacatctacttgtgggcctagtttcagagctatgctggaaacagc

SEQ ID NO: 63885 - DNA, 70 bp, Artificial Sequence
  Synthetic
gccaagcatttaggtgacactatagacaggaagcacaaattctgagtttcagagctatgctggaaacagc

SEQ ID NO: 63886 - DNA, 70 bp, Artificial Sequence
  Synthetic
gccaagcatttaggtgacactatagtggagaagacgaagattcctgtttcagagctatgctggaaacagc

SEQ ID NO: 63887 - DNA, 70 bp, Artificial Sequence
  Synthetic
gccaagcatttaggtgacactataggacagccccacctggttcaagtttcagagctatgctggaaacagc

SEQ ID NO: 63888 - DNA, 70 bp, Artificial Sequence
  Synthetic
gccaagcatttaggtgacactataggaaaccacggttggcatcaagtttcagagctatgctggaaacagc

SEQ ID NO: 63889 - DNA, 70 bp, Artificial Sequence
  Synthetic
gccaagcatttaggtgacactatagctgtctacccccagcatgaggtttcagagctatgctggaaacagc

SEQ ID NO: 63890 - DNA, 70 bp, Artificial Sequence
  Synthetic
gccaagcatttaggtgacactatagcgacatgttttttgtaaggcgtttcagagctatgctggaaacagc

SEQ ID NO: 63891 - DNA, 70 bp, Artificial Sequence
  Synthetic
gccaagcatttaggtgacactatagtgcctcagagaccaactgaggtttcagagctatgctggaaacagc

SEQ ID NO: 63892 - DNA, 70 bp, Artificial Sequence
  Synthetic
gccaagcatttaggtgacactataggctacactgggcctaggtgagtttcagagctatgctggaaacagc

SEQ ID NO: 63893 - DNA, 70 bp, Artificial Sequence
  Synthetic
gccaagcatttaggtgacactataggacgacttcgtgatttgaatgtttcagagctatgctggaaacagc

SEQ ID NO: 63894 - DNA, 70 bp, Artificial Sequence
  Synthetic
gccaagcatttaggtgacactatagcagtgctcaaagggaagagagtttcagagctatgctggaaacagc

SEQ ID NO: 63895 - DNA, 70 bp, Artificial Sequence
  Synthetic
gccaagcatttaggtgacactatagaaccctggcccctcggctacgtttcagagctatgctggaaacagc

SEQ ID NO: 63896 - DNA, 70 bp, Artificial Sequence
  Synthetic
gccaagcatttaggtgacactatagagtttctacagatcagctaggtttcagagctatgctggaaacagc

SEQ ID NO: 63897 - DNA, 70 bp, Artificial Sequence
  Synthetic
gccaagcatttaggtgacactatagttcccaggcccaccctcagtgtttcagagctatgctggaaacagc

SEQ ID NO: 63898 - DNA, 70 bp, Artificial Sequence
  Synthetic
gccaagcatttaggtgacactataggggacacgggtgagtcactggtttcagagctatgctggaaacagc

SEQ ID NO: 63899 - DNA, 70 bp, Artificial Sequence
  Synthetic
gccaagcatttaggtgacactatagcagccagcataacatcctaagtttcagagctatgctggaaacagc

SEQ ID NO: 63900 - DNA, 70 bp, Artificial Sequence
  Synthetic
gccaagcatttaggtgacactatagattcttccccattaattacggtttcagagctatgctggaaacagc

SEQ ID NO: 63901 - DNA, 70 bp, Artificial Sequence
  Synthetic
gccaagcatttaggtgacactatagccagaaaaccaaggagaattgtttcagagctatgctggaaacagc

SEQ ID NO: 63902 - DNA, 70 bp, Artificial Sequence
  Synthetic
gccaagcatttaggtgacactatagagcagttctaagtaggtaatgtttcagagctatgctggaaacagc

SEQ ID NO: 63903 - DNA, 70 bp, Artificial Sequence
  Synthetic
gccaagcatttaggtgacactatagctagctgagcagttccaagtgtttcagagctatgctggaaacagc

SEQ ID NO: 63904 - DNA, 70 bp, Artificial Sequence
  Synthetic
gccaagcatttaggtgacactatagttggaactgctcagctaggcgtttcagagctatgctggaaacagc

SEQ ID NO: 63905 - DNA, 70 bp, Artificial Sequence
  Synthetic
gccaagcatttaggtgacactatagaagagaagaaaatccggcttgtttcagagctatgctggaaacagc

SEQ ID NO: 63906 - DNA, 70 bp, Artificial Sequence
  Synthetic
gccaagcatttaggtgacactatagtctgctagttctttttctcagtttcagagctatgctggaaacagc

SEQ ID NO: 63907 - DNA, 70 bp, Artificial Sequence
  Synthetic
gccaagcatttaggtgacactatagacgtggttctcacatctccagtttcagagctatgctggaaacagc

SEQ ID NO: 63908 - DNA, 70 bp, Artificial Sequence
  Synthetic
gccaagcatttaggtgacactatagcggcttctttctgagatagtgtttcagagctatgctggaaacagc

SEQ ID NO: 63909 - DNA, 70 bp, Artificial Sequence
  Synthetic
gccaagcatttaggtgacactatagagctttgtggaaaacatatggtttcagagctatgctggaaacagc

SEQ ID NO: 63910 - DNA, 70 bp, Artificial Sequence
  Synthetic
gccaagcatttaggtgacactatagccacccgtaggttcatttgcgtttcagagctatgctggaaacagc

SEQ ID NO: 63911 - DNA, 70 bp, Artificial Sequence
  Synthetic
gccaagcatttaggtgacactatagaagctctcgacgaagctgccgtttcagagctatgctggaaacagc

SEQ ID NO: 63912 - DNA, 70 bp, Artificial Sequence
  Synthetic
gccaagcatttaggtgacactatagcttggatgctgtcctcagcggtttcagagctatgctggaaacagc

SEQ ID NO: 63913 - DNA, 70 bp, Artificial Sequence
  Synthetic
gccaagcatttaggtgacactataggacaggacagctttcctcaggtttcagagctatgctggaaacagc

SEQ ID NO: 63914 - DNA, 70 bp, Artificial Sequence
  Synthetic
gccaagcatttaggtgacactatagttcatggttacgtagttggcgtttcagagctatgctggaaacagc

SEQ ID NO: 63915 - DNA, 70 bp, Artificial Sequence
  Synthetic
gccaagcatttaggtgacactatagaattcttcctggagaggtgagtttcagagctatgctggaaacagc

SEQ ID NO: 63916 - DNA, 70 bp, Artificial Sequence
  Synthetic
gccaagcatttaggtgacactatagaaacagctgctggacagatagtttcagagctatgctggaaacagc

SEQ ID NO: 63917 - DNA, 70 bp, Artificial Sequence
  Synthetic
gccaagcatttaggtgacactatagcgcgcgctcaggcagctggagtttcagagctatgctggaaacagc

SEQ ID NO: 63918 - DNA, 70 bp, Artificial Sequence
  Synthetic
gccaagcatttaggtgacactataggctaggtggaagctgcagcagtttcagagctatgctggaaacagc

SEQ ID NO: 63919 - DNA, 70 bp, Artificial Sequence
  Synthetic
gccaagcatttaggtgacactatagggcaggtctggtccgctcacgtttcagagctatgctggaaacagc

SEQ ID NO: 63920 - DNA, 70 bp, Artificial Sequence
  Synthetic
gccaagcatttaggtgacactataggttcttaggtggagctttaagtttcagagctatgctggaaacagc

SEQ ID NO: 63921 - DNA, 70 bp, Artificial Sequence
  Synthetic
gccaagcatttaggtgacactatagtccacctctttttgcctgaagtttcagagctatgctggaaacagc

SEQ ID NO: 63922 - DNA, 70 bp, Artificial Sequence
  Synthetic
gccaagcatttaggtgacactataggtctacagcaacctgtggaggtttcagagctatgctggaaacagc

SEQ ID NO: 63923 - DNA, 70 bp, Artificial Sequence
  Synthetic
gccaagcatttaggtgacactatagcctgcgtggcgtggtctcacgtttcagagctatgctggaaacagc

SEQ ID NO: 63924 - DNA, 70 bp, Artificial Sequence
  Synthetic
gccaagcatttaggtgacactataggtggagaggaagcagtgaccgtttcagagctatgctggaaacagc

SEQ ID NO: 63925 - DNA, 70 bp, Artificial Sequence
  Synthetic
gccaagcatttaggtgacactatagttgttggaatgcaaaagtgcgtttcagagctatgctggaaacagc

SEQ ID NO: 63926 - DNA, 70 bp, Artificial Sequence
  Synthetic
gccaagcatttaggtgacactatagtggaatgggaaaggtagtttgtttcagagctatgctggaaacagc

SEQ ID NO: 63927 - DNA, 70 bp, Artificial Sequence
  Synthetic
gccaagcatttaggtgacactataggatagaagcaaacgtcaagggtttcagagctatgctggaaacagc

SEQ ID NO: 63928 - DNA, 70 bp, Artificial Sequence
  Synthetic
gccaagcatttaggtgacactataggggccgagggtcactgtcaggtttcagagctatgctggaaacagc

SEQ ID NO: 63929 - DNA, 70 bp, Artificial Sequence
  Synthetic
gccaagcatttaggtgacactatagtagtgaagcttgctgtgcacgtttcagagctatgctggaaacagc

SEQ ID NO: 63930 - DNA, 70 bp, Artificial Sequence
  Synthetic
gccaagcatttaggtgacactataggcttcatgtgcatgaatcccgtttcagagctatgctggaaacagc

SEQ ID NO: 63931 - DNA, 70 bp, Artificial Sequence
  Synthetic
gccaagcatttaggtgacactatagggcttcacatctaaagagtcgtttcagagctatgctggaaacagc

SEQ ID NO: 63932 - DNA, 70 bp, Artificial Sequence
  Synthetic
gccaagcatttaggtgacactatagtggtctcactgttgcgcaccgtttcagagctatgctggaaacagc

SEQ ID NO: 63933 - DNA, 70 bp, Artificial Sequence
  Synthetic
gccaagcatttaggtgacactatagattgtgatacacgttttgacgtttcagagctatgctggaaacagc

SEQ ID NO: 63934 - DNA, 70 bp, Artificial Sequence
  Synthetic
gccaagcatttaggtgacactatagcccggccccccggcttcagcgtttcagagctatgctggaaacagc

SEQ ID NO: 63935 - DNA, 70 bp, Artificial Sequence
  Synthetic
gccaagcatttaggtgacactatagctcggttatacagtcaccgcgtttcagagctatgctggaaacagc

SEQ ID NO: 63936 - DNA, 70 bp, Artificial Sequence
  Synthetic
gccaagcatttaggtgacactatagcatggcctgggcgtgtcaacgtttcagagctatgctggaaacagc

SEQ ID NO: 63937 - DNA, 70 bp, Artificial Sequence
  Synthetic
gccaagcatttaggtgacactatagccctcttacccgggagcctggtttcagagctatgctggaaacagc

SEQ ID NO: 63938 - DNA, 70 bp, Artificial Sequence
  Synthetic
gccaagcatttaggtgacactatagagaggccagggaatgctcaggtttcagagctatgctggaaacagc

SEQ ID NO: 63939 - DNA, 70 bp, Artificial Sequence
  Synthetic
gccaagcatttaggtgacactatagatgttgtgtgtgtgcgtgaggtttcagagctatgctggaaacagc

SEQ ID NO: 63940 - DNA, 70 bp, Artificial Sequence
  Synthetic
gccaagcatttaggtgacactataggggaagagaactgagtgtgcgtttcagagctatgctggaaacagc

SEQ ID NO: 63941 - DNA, 70 bp, Artificial Sequence
  Synthetic
gccaagcatttaggtgacactataggaccgaagtgaccgtgtgacgtttcagagctatgctggaaacagc

SEQ ID NO: 63942 - DNA, 70 bp, Artificial Sequence
  Synthetic
gccaagcatttaggtgacactatagaagaacgaggtgactgtctggtttcagagctatgctggaaacagc

SEQ ID NO: 63943 - DNA, 70 bp, Artificial Sequence
  Synthetic
gccaagcatttaggtgacactatagaccgaggtcaccgtgtgaaggtttcagagctatgctggaaacagc

SEQ ID NO: 63944 - DNA, 70 bp, Artificial Sequence
  Synthetic
gccaagcatttaggtgacactatagagtcacttctgttttgctgtgtttcagagctatgctggaaacagc

SEQ ID NO: 63945 - DNA, 70 bp, Artificial Sequence
  Synthetic
gccaagcatttaggtgacactatagtccgtgcactcagactgtccgtttcagagctatgctggaaacagc

SEQ ID NO: 63946 - DNA, 70 bp, Artificial Sequence
  Synthetic
gccaagcatttaggtgacactatagtggcagctgcgttgttcaaagtttcagagctatgctggaaacagc

SEQ ID NO: 63947 - DNA, 70 bp, Artificial Sequence
  Synthetic
gccaagcatttaggtgacactatagctggcctgcctgacttctaagtttcagagctatgctggaaacagc

SEQ ID NO: 63948 - DNA, 70 bp, Artificial Sequence
  Synthetic
gccaagcatttaggtgacactatagctggttttgatgagcattgagtttcagagctatgctggaaacagc

SEQ ID NO: 63949 - DNA, 70 bp, Artificial Sequence
  Synthetic
gccaagcatttaggtgacactatagagcagatttatatcagaccagtttcagagctatgctggaaacagc

SEQ ID NO: 63950 - DNA, 70 bp, Artificial Sequence
  Synthetic
gccaagcatttaggtgacactataggcgcggcgggtcagagccccgtttcagagctatgctggaaacagc

SEQ ID NO: 63951 - DNA, 70 bp, Artificial Sequence
  Synthetic
gccaagcatttaggtgacactatagtcgcccgggctggagtataagtttcagagctatgctggaaacagc

SEQ ID NO: 63952 - DNA, 70 bp, Artificial Sequence
  Synthetic
gccaagcatttaggtgacactatagggcgttggcgtcacagacccgtttcagagctatgctggaaacagc

SEQ ID NO: 63953 - DNA, 70 bp, Artificial Sequence
  Synthetic
gccaagcatttaggtgacactatagttgctgtctaagattccttcgtttcagagctatgctggaaacagc

SEQ ID NO: 63954 - DNA, 70 bp, Artificial Sequence
  Synthetic
gccaagcatttaggtgacactatagatagggagggtgcaccgaatgtttcagagctatgctggaaacagc

SEQ ID NO: 63955 - DNA, 70 bp, Artificial Sequence
  Synthetic
gccaagcatttaggtgacactatagttcaagctcttcagtttcttgtttcagagctatgctggaaacagc

SEQ ID NO: 63956 - DNA, 70 bp, Artificial Sequence
  Synthetic
gccaagcatttaggtgacactatagagcaatattcaggagagagagtttcagagctatgctggaaacagc

SEQ ID NO: 63957 - DNA, 70 bp, Artificial Sequence
  Synthetic
gccaagcatttaggtgacactatagtctccacctataactatgtagtttcagagctatgctggaaacagc

SEQ ID NO: 63958 - DNA, 70 bp, Artificial Sequence
  Synthetic
gccaagcatttaggtgacactatagggtctcttatttgcccctttgtttcagagctatgctggaaacagc

SEQ ID NO: 63959 - DNA, 70 bp, Artificial Sequence
  Synthetic
gccaagcatttaggtgacactatagtagaagaggttaaagtggaggtttcagagctatgctggaaacagc

SEQ ID NO: 63960 - DNA, 70 bp, Artificial Sequence
  Synthetic
gccaagcatttaggtgacactatagattagaaattgctgggccccgtttcagagctatgctggaaacagc

SEQ ID NO: 63961 - DNA, 70 bp, Artificial Sequence
  Synthetic
gccaagcatttaggtgacactatagctggtttatggatcagcagtgtttcagagctatgctggaaacagc

SEQ ID NO: 63962 - DNA, 70 bp, Artificial Sequence
  Synthetic
gccaagcatttaggtgacactatagggaaggatgcacaagttccagtttcagagctatgctggaaacagc

SEQ ID NO: 63963 - DNA, 70 bp, Artificial Sequence
  Synthetic
gccaagcatttaggtgacactatagtttcctgcatccaatgctacgtttcagagctatgctggaaacagc

SEQ ID NO: 63964 - DNA, 70 bp, Artificial Sequence
  Synthetic
gccaagcatttaggtgacactatagttctagagtaacattgtgtggtttcagagctatgctggaaacagc

SEQ ID NO: 63965 - DNA, 70 bp, Artificial Sequence
  Synthetic
gccaagcatttaggtgacactataggcaacattgctctgatgtccgtttcagagctatgctggaaacagc

SEQ ID NO: 63966 - DNA, 70 bp, Artificial Sequence
  Synthetic
gccaagcatttaggtgacactatagttgattgccatttcaacacagtttcagagctatgctggaaacagc

SEQ ID NO: 63967 - DNA, 70 bp, Artificial Sequence
  Synthetic
gccaagcatttaggtgacactatagtttgcagataatgggaacctgtttcagagctatgctggaaacagc

SEQ ID NO: 63968 - DNA, 70 bp, Artificial Sequence
  Synthetic
gccaagcatttaggtgacactatagccctcagaagctgaaatgtggtttcagagctatgctggaaacagc

SEQ ID NO: 63969 - DNA, 70 bp, Artificial Sequence
  Synthetic
gccaagcatttaggtgacactatagatgttggaggttcagaagacgtttcagagctatgctggaaacagc

SEQ ID NO: 63970 - DNA, 70 bp, Artificial Sequence
  Synthetic
gccaagcatttaggtgacactatagcaagatctatgtcttctagcgtttcagagctatgctggaaacagc

SEQ ID NO: 63971 - DNA, 70 bp, Artificial Sequence
  Synthetic
gccaagcatttaggtgacactatagtgggagctacatatcatcctgtttcagagctatgctggaaacagc

SEQ ID NO: 63972 - DNA, 70 bp, Artificial Sequence
  Synthetic
gccaagcatttaggtgacactataggcaacaccactggtcagcccgtttcagagctatgctggaaacagc

SEQ ID NO: 63973 - DNA, 70 bp, Artificial Sequence
  Synthetic
gccaagcatttaggtgacactatagaaagcctaagagaccctcatgtttcagagctatgctggaaacagc

SEQ ID NO: 63974 - DNA, 70 bp, Artificial Sequence
  Synthetic
gccaagcatttaggtgacactataggggatggttccaaagtgaaggtttcagagctatgctggaaacagc

SEQ ID NO: 63975 - DNA, 70 bp, Artificial Sequence
  Synthetic
gccaagcatttaggtgacactatagagtctctgcagtttctcactgtttcagagctatgctggaaacagc

SEQ ID NO: 63976 - DNA, 70 bp, Artificial Sequence
  Synthetic
gccaagcatttaggtgacactatagtgagcgggaggggctcagccgtttcagagctatgctggaaacagc

SEQ ID NO: 63977 - DNA, 70 bp, Artificial Sequence
  Synthetic
gccaagcatttaggtgacactataggccaccatgtgctcaccgtggtttcagagctatgctggaaacagc

SEQ ID NO: 63978 - DNA, 70 bp, Artificial Sequence
  Synthetic
gccaagcatttaggtgacactatagggaggctgcagacgctgtcagtttcagagctatgctggaaacagc

SEQ ID NO: 63979 - DNA, 70 bp, Artificial Sequence
  Synthetic
gccaagcatttaggtgacactataggagatcaagacaagcaagtggtttcagagctatgctggaaacagc

SEQ ID NO: 63980 - DNA, 70 bp, Artificial Sequence
  Synthetic
gccaagcatttaggtgacactataggagatggggccagcctcagcgtttcagagctatgctggaaacagc

SEQ ID NO: 63981 - DNA, 70 bp, Artificial Sequence
  Synthetic
gccaagcatttaggtgacactataggatttctgagtactcagtgtgtttcagagctatgctggaaacagc

SEQ ID NO: 63982 - DNA, 70 bp, Artificial Sequence
  Synthetic
gccaagcatttaggtgacactatagggtctgaaactatgcctgtcgtttcagagctatgctggaaacagc

SEQ ID NO: 63983 - DNA, 70 bp, Artificial Sequence
  Synthetic
gccaagcatttaggtgacactatagagcctctgcattttcttactgtttcagagctatgctggaaacagc

SEQ ID NO: 63984 - DNA, 70 bp, Artificial Sequence
  Synthetic
gccaagcatttaggtgacactatagcagctctctgtgaacgtgacgtttcagagctatgctggaaacagc

SEQ ID NO: 63985 - DNA, 70 bp, Artificial Sequence
  Synthetic
gccaagcatttaggtgacactatagccctccagcaaagaagtcaggtttcagagctatgctggaaacagc

SEQ ID NO: 63986 - DNA, 70 bp, Artificial Sequence
  Synthetic
gccaagcatttaggtgacactatagtctctgcagtttctcatctggtttcagagctatgctggaaacagc

SEQ ID NO: 63987 - DNA, 70 bp, Artificial Sequence
  Synthetic
gccaagcatttaggtgacactatagtggttcttcctcatctgtgtgtttcagagctatgctggaaacagc

SEQ ID NO: 63988 - DNA, 70 bp, Artificial Sequence
  Synthetic
gccaagcatttaggtgacactataggcatgttccacaggcttagcgtttcagagctatgctggaaacagc

SEQ ID NO: 63989 - DNA, 70 bp, Artificial Sequence
  Synthetic
gccaagcatttaggtgacactatagccgtgtactaccgtctccccgtttcagagctatgctggaaacagc

SEQ ID NO: 63990 - DNA, 70 bp, Artificial Sequence
  Synthetic
gccaagcatttaggtgacactatagccttgaccagccaggcctgagtttcagagctatgctggaaacagc

SEQ ID NO: 63991 - DNA, 70 bp, Artificial Sequence
  Synthetic
gccaagcatttaggtgacactatagcttcaggcctggctggtcaagtttcagagctatgctggaaacagc

SEQ ID NO: 63992 - DNA, 70 bp, Artificial Sequence
  Synthetic
gccaagcatttaggtgacactatagtccacagctgttgcctcaccgtttcagagctatgctggaaacagc

SEQ ID NO: 63993 - DNA, 70 bp, Artificial Sequence
  Synthetic
gccaagcatttaggtgacactatagcgtttgtcctggtgcagtgagtttcagagctatgctggaaacagc

SEQ ID NO: 63994 - DNA, 70 bp, Artificial Sequence
  Synthetic
gccaagcatttaggtgacactatagtgtgctgagactaattcaccgtttcagagctatgctggaaacagc

SEQ ID NO: 63995 - DNA, 70 bp, Artificial Sequence
  Synthetic
gccaagcatttaggtgacactatagtccttcagcatggagcaggcgtttcagagctatgctggaaacagc

SEQ ID NO: 63996 - DNA, 70 bp, Artificial Sequence
  Synthetic
gccaagcatttaggtgacactatagagttcagttatttgatggctgtttcagagctatgctggaaacagc

SEQ ID NO: 63997 - DNA, 70 bp, Artificial Sequence
  Synthetic
gccaagcatttaggtgacactatagttgctgaaggagctgagatggtttcagagctatgctggaaacagc

SEQ ID NO: 63998 - DNA, 70 bp, Artificial Sequence
  Synthetic
gccaagcatttaggtgacactatagagcaaaacatcagcttccgtgtttcagagctatgctggaaacagc

SEQ ID NO: 63999 - DNA, 70 bp, Artificial Sequence
  Synthetic
gccaagcatttaggtgacactatagcctctttctgcttctaagtagtttcagagctatgctggaaacagc

SEQ ID NO: 64000 - DNA, 70 bp, Artificial Sequence
  Synthetic
gccaagcatttaggtgacactataggccagcgggtcacctcccgtgtttcagagctatgctggaaacagc

SEQ ID NO: 64001 - DNA, 70 bp, Artificial Sequence
  Synthetic
gccaagcatttaggtgacactatagagggctggagcggctcctgagtttcagagctatgctggaaacagc

SEQ ID NO: 64002 - DNA, 70 bp, Artificial Sequence
  Synthetic
gccaagcatttaggtgacactatagtgctctggctttgcagttaagtttcagagctatgctggaaacagc

SEQ ID NO: 64003 - DNA, 70 bp, Artificial Sequence
  Synthetic
gccaagcatttaggtgacactatagcatgagggcgggtcagggcggtttcagagctatgctggaaacagc

SEQ ID NO: 64004 - DNA, 70 bp, Artificial Sequence
  Synthetic
gccaagcatttaggtgacactatagtgcccatctccactcaggaggtttcagagctatgctggaaacagc

SEQ ID NO: 64005 - DNA, 70 bp, Artificial Sequence
  Synthetic
gccaagcatttaggtgacactatagggttccagacggctcaggccgtttcagagctatgctggaaacagc

SEQ ID NO: 64006 - DNA, 70 bp, Artificial Sequence
  Synthetic
gccaagcatttaggtgacactatagaacaccatagacatgagctagtttcagagctatgctggaaacagc

SEQ ID NO: 64007 - DNA, 70 bp, Artificial Sequence
  Synthetic
gccaagcatttaggtgacactatagtggctaagattttttgtcgagtttcagagctatgctggaaacagc

SEQ ID NO: 64008 - DNA, 70 bp, Artificial Sequence
  Synthetic
gccaagcatttaggtgacactataggagaagaaggagctctgagggtttcagagctatgctggaaacagc

SEQ ID NO: 64009 - DNA, 70 bp, Artificial Sequence
  Synthetic
gccaagcatttaggtgacactatagcaggtcccgaggaagtgaatgtttcagagctatgctggaaacagc

SEQ ID NO: 64010 - DNA, 70 bp, Artificial Sequence
  Synthetic
gccaagcatttaggtgacactatagctacatctgctggaaacagagtttcagagctatgctggaaacagc

SEQ ID NO: 64011 - DNA, 70 bp, Artificial Sequence
  Synthetic
gccaagcatttaggtgacactatagctatgtctactggaagcagagtttcagagctatgctggaaacagc

SEQ ID NO: 64012 - DNA, 70 bp, Artificial Sequence
  Synthetic
gccaagcatttaggtgacactataggagcaagggtcaagagtgaggtttcagagctatgctggaaacagc

SEQ ID NO: 64013 - DNA, 70 bp, Artificial Sequence
  Synthetic
gccaagcatttaggtgacactatagctccggctgctgggactcacgtttcagagctatgctggaaacagc

SEQ ID NO: 64014 - DNA, 70 bp, Artificial Sequence
  Synthetic
gccaagcatttaggtgacactatagagtcaggtcttctgcttccagtttcagagctatgctggaaacagc

SEQ ID NO: 64015 - DNA, 70 bp, Artificial Sequence
  Synthetic
gccaagcatttaggtgacactatagtgaagctatatctgtgaaacgtttcagagctatgctggaaacagc

SEQ ID NO: 64016 - DNA, 70 bp, Artificial Sequence
  Synthetic
gccaagcatttaggtgacactatagctgggagatgcagctgtcacgtttcagagctatgctggaaacagc

SEQ ID NO: 64017 - DNA, 70 bp, Artificial Sequence
  Synthetic
gccaagcatttaggtgacactatagctggtcgcattcacccagccgtttcagagctatgctggaaacagc

SEQ ID NO: 64018 - DNA, 70 bp, Artificial Sequence
  Synthetic
gccaagcatttaggtgacactataggcttgatggaccagacaaatgtttcagagctatgctggaaacagc

SEQ ID NO: 64019 - DNA, 70 bp, Artificial Sequence
  Synthetic
gccaagcatttaggtgacactatagatatcaggctgtggtcagcagtttcagagctatgctggaaacagc

SEQ ID NO: 64020 - DNA, 70 bp, Artificial Sequence
  Synthetic
gccaagcatttaggtgacactataggaatctgttcgtagctgggggtttcagagctatgctggaaacagc

SEQ ID NO: 64021 - DNA, 70 bp, Artificial Sequence
  Synthetic
gccaagcatttaggtgacactatagtttcattttcatgacaggcagtttcagagctatgctggaaacagc

SEQ ID NO: 64022 - DNA, 70 bp, Artificial Sequence
  Synthetic
gccaagcatttaggtgacactatagacgttgacgaggtcatgaccgtttcagagctatgctggaaacagc

SEQ ID NO: 64023 - DNA, 70 bp, Artificial Sequence
  Synthetic
gccaagcatttaggtgacactatagaaggcggtccccagctgaccgtttcagagctatgctggaaacagc

SEQ ID NO: 64024 - DNA, 70 bp, Artificial Sequence
  Synthetic
gccaagcatttaggtgacactataggctgcacaaaacgcacaaaagtttcagagctatgctggaaacagc

SEQ ID NO: 64025 - DNA, 70 bp, Artificial Sequence
  Synthetic
gccaagcatttaggtgacactatagcagcctgcagccagctgagagtttcagagctatgctggaaacagc

SEQ ID NO: 64026 - DNA, 70 bp, Artificial Sequence
  Synthetic
gccaagcatttaggtgacactatagtgtgccatgttcgagacctggtttcagagctatgctggaaacagc

SEQ ID NO: 64027 - DNA, 70 bp, Artificial Sequence
  Synthetic
gccaagcatttaggtgacactataggtggacttggggtcctaagtgtttcagagctatgctggaaacagc

SEQ ID NO: 64028 - DNA, 70 bp, Artificial Sequence
  Synthetic
gccaagcatttaggtgacactatagcaaatgggttctaggagcccgtttcagagctatgctggaaacagc

SEQ ID NO: 64029 - DNA, 70 bp, Artificial Sequence
  Synthetic
gccaagcatttaggtgacactatagctcggtaacctccagcgactgtttcagagctatgctggaaacagc

SEQ ID NO: 64030 - DNA, 70 bp, Artificial Sequence
  Synthetic
gccaagcatttaggtgacactatagcttgcatatcttcatccagcgtttcagagctatgctggaaacagc

SEQ ID NO: 64031 - DNA, 70 bp, Artificial Sequence
  Synthetic
gccaagcatttaggtgacactatagcacactgggtcacagttccagtttcagagctatgctggaaacagc

SEQ ID NO: 64032 - DNA, 70 bp, Artificial Sequence
  Synthetic
gccaagcatttaggtgacactataggatgtcgcactcgctgtcgcgtttcagagctatgctggaaacagc

SEQ ID NO: 64033 - DNA, 70 bp, Artificial Sequence
  Synthetic
gccaagcatttaggtgacactatagctatcagaggtccgaggggggtttcagagctatgctggaaacagc

SEQ ID NO: 64034 - DNA, 70 bp, Artificial Sequence
  Synthetic
gccaagcatttaggtgacactatagcaactgaaagcattacctccgtttcagagctatgctggaaacagc

SEQ ID NO: 64035 - DNA, 70 bp, Artificial Sequence
  Synthetic
gccaagcatttaggtgacactatagactacagaagcaaacagaccgtttcagagctatgctggaaacagc

SEQ ID NO: 64036 - DNA, 70 bp, Artificial Sequence
  Synthetic
gccaagcatttaggtgacactatagggattacattcaatacaggcgtttcagagctatgctggaaacagc

SEQ ID NO: 64037 - DNA, 70 bp, Artificial Sequence
  Synthetic
gccaagcatttaggtgacactatagtctgtgttggatagatccacgtttcagagctatgctggaaacagc

SEQ ID NO: 64038 - DNA, 70 bp, Artificial Sequence
  Synthetic
gccaagcatttaggtgacactatagtttctttgttgctgacatctgtttcagagctatgctggaaacagc

SEQ ID NO: 64039 - DNA, 70 bp, Artificial Sequence
  Synthetic
gccaagcatttaggtgacactatagtctcaccactgcctttgaaggtttcagagctatgctggaaacagc

SEQ ID NO: 64040 - DNA, 70 bp, Artificial Sequence
  Synthetic
gccaagcatttaggtgacactatagggtgcctaaagcctacataagtttcagagctatgctggaaacagc

SEQ ID NO: 64041 - DNA, 70 bp, Artificial Sequence
  Synthetic
gccaagcatttaggtgacactatagcagcgagggcgctgcggagcgtttcagagctatgctggaaacagc

SEQ ID NO: 64042 - DNA, 70 bp, Artificial Sequence
  Synthetic
gccaagcatttaggtgacactatagttccacctagtcacaaattcgtttcagagctatgctggaaacagc

SEQ ID NO: 64043 - DNA, 70 bp, Artificial Sequence
  Synthetic
gccaagcatttaggtgacactatagagatgaactcagacaggaacgtttcagagctatgctggaaacagc

SEQ ID NO: 64044 - DNA, 70 bp, Artificial Sequence
  Synthetic
gccaagcatttaggtgacactatagtttttacatggggcattcacgtttcagagctatgctggaaacagc

SEQ ID NO: 64045 - DNA, 70 bp, Artificial Sequence
  Synthetic
gccaagcatttaggtgacactatagttagctgactctacaagtaggtttcagagctatgctggaaacagc

SEQ ID NO: 64046 - DNA, 70 bp, Artificial Sequence
  Synthetic
gccaagcatttaggtgacactataggggcaacagcggtggcttgagtttcagagctatgctggaaacagc

SEQ ID NO: 64047 - DNA, 70 bp, Artificial Sequence
  Synthetic
gccaagcatttaggtgacactatagatgcttctggaggagattttgtttcagagctatgctggaaacagc

SEQ ID NO: 64048 - DNA, 70 bp, Artificial Sequence
  Synthetic
gccaagcatttaggtgacactatagttgatcaggaaagaaaagctgtttcagagctatgctggaaacagc

SEQ ID NO: 64049 - DNA, 70 bp, Artificial Sequence
  Synthetic
gccaagcatttaggtgacactatagaaaactgtgtgctacctaccgtttcagagctatgctggaaacagc

SEQ ID NO: 64050 - DNA, 70 bp, Artificial Sequence
  Synthetic
gccaagcatttaggtgacactatagttcacttctcttcacaccacgtttcagagctatgctggaaacagc

SEQ ID NO: 64051 - DNA, 70 bp, Artificial Sequence
  Synthetic
gccaagcatttaggtgacactatagtacagattactctgacatgtgtttcagagctatgctggaaacagc

SEQ ID NO: 64052 - DNA, 70 bp, Artificial Sequence
  Synthetic
gccaagcatttaggtgacactatagtgggcttttgcagtgtcagtgtttcagagctatgctggaaacagc

SEQ ID NO: 64053 - DNA, 70 bp, Artificial Sequence
  Synthetic
gccaagcatttaggtgacactatagctcatcaccaccttactttggtttcagagctatgctggaaacagc

SEQ ID NO: 64054 - DNA, 70 bp, Artificial Sequence
  Synthetic
gccaagcatttaggtgacactatagttgcagatgggtgccctgaagtttcagagctatgctggaaacagc

SEQ ID NO: 64055 - DNA, 70 bp, Artificial Sequence
  Synthetic
gccaagcatttaggtgacactatagctgtggcagcttcagaaaacgtttcagagctatgctggaaacagc

SEQ ID NO: 64056 - DNA, 70 bp, Artificial Sequence
  Synthetic
gccaagcatttaggtgacactatagtgtctctttggatgatgcctgtttcagagctatgctggaaacagc

SEQ ID NO: 64057 - DNA, 70 bp, Artificial Sequence
  Synthetic
gccaagcatttaggtgacactatagagggatggaaattggagagagtttcagagctatgctggaaacagc

SEQ ID NO: 64058 - DNA, 70 bp, Artificial Sequence
  Synthetic
gccaagcatttaggtgacactatagaaagatgacagttggaaagagtttcagagctatgctggaaacagc

SEQ ID NO: 64059 - DNA, 70 bp, Artificial Sequence
  Synthetic
gccaagcatttaggtgacactatagcacactagcatagactgtgagtttcagagctatgctggaaacagc

SEQ ID NO: 64060 - DNA, 70 bp, Artificial Sequence
  Synthetic
gccaagcatttaggtgacactatagggtctctggtgtcagctctcgtttcagagctatgctggaaacagc

SEQ ID NO: 64061 - DNA, 70 bp, Artificial Sequence
  Synthetic
gccaagcatttaggtgacactatagcaacttacacgacattgtcagtttcagagctatgctggaaacagc

SEQ ID NO: 64062 - DNA, 70 bp, Artificial Sequence
  Synthetic
gccaagcatttaggtgacactatagttctcataggcaaatagcctgtttcagagctatgctggaaacagc

SEQ ID NO: 64063 - DNA, 70 bp, Artificial Sequence
  Synthetic
gccaagcatttaggtgacactatagttgtgcaggatctgccataagtttcagagctatgctggaaacagc

SEQ ID NO: 64064 - DNA, 70 bp, Artificial Sequence
  Synthetic
gccaagcatttaggtgacactatagattgctcatcttcttgctctgtttcagagctatgctggaaacagc

SEQ ID NO: 64065 - DNA, 70 bp, Artificial Sequence
  Synthetic
gccaagcatttaggtgacactatagttcccaaggagcagtcaggcgtttcagagctatgctggaaacagc

SEQ ID NO: 64066 - DNA, 70 bp, Artificial Sequence
  Synthetic
gccaagcatttaggtgacactatagcagatgaaagtgtcctaatggtttcagagctatgctggaaacagc

SEQ ID NO: 64067 - DNA, 70 bp, Artificial Sequence
  Synthetic
gccaagcatttaggtgacactataggccagggggcagttagctcagtttcagagctatgctggaaacagc

SEQ ID NO: 64068 - DNA, 70 bp, Artificial Sequence
  Synthetic
gccaagcatttaggtgacactataggggaagggctaggctgtgcagtttcagagctatgctggaaacagc

SEQ ID NO: 64069 - DNA, 70 bp, Artificial Sequence
  Synthetic
gccaagcatttaggtgacactatagcttgatgtctacttttcgtcgtttcagagctatgctggaaacagc

SEQ ID NO: 64070 - DNA, 70 bp, Artificial Sequence
  Synthetic
gccaagcatttaggtgacactatagagcctgttcccagttccctggtttcagagctatgctggaaacagc

SEQ ID NO: 64071 - DNA, 70 bp, Artificial Sequence
  Synthetic
gccaagcatttaggtgacactatagcatttagagagaagtctgaggtttcagagctatgctggaaacagc

SEQ ID NO: 64072 - DNA, 70 bp, Artificial Sequence
  Synthetic
gccaagcatttaggtgacactatagtttacagtagccatgtgttcgtttcagagctatgctggaaacagc

SEQ ID NO: 64073 - DNA, 70 bp, Artificial Sequence
  Synthetic
gccaagcatttaggtgacactatagatcacttcatgtgaatagcagtttcagagctatgctggaaacagc

SEQ ID NO: 64074 - DNA, 70 bp, Artificial Sequence
  Synthetic
gccaagcatttaggtgacactatagcaaggcagttggtggaaatggtttcagagctatgctggaaacagc

SEQ ID NO: 64075 - DNA, 70 bp, Artificial Sequence
  Synthetic
gccaagcatttaggtgacactatagcacctcctttgttatactgtgtttcagagctatgctggaaacagc

SEQ ID NO: 64076 - DNA, 70 bp, Artificial Sequence
  Synthetic
gccaagcatttaggtgacactatagcttgaataatccagaaggctgtttcagagctatgctggaaacagc

SEQ ID NO: 64077 - DNA, 70 bp, Artificial Sequence
  Synthetic
gccaagcatttaggtgacactatagtattgttgcaacagcaatgtgtttcagagctatgctggaaacagc

SEQ ID NO: 64078 - DNA, 70 bp, Artificial Sequence
  Synthetic
gccaagcatttaggtgacactatagttcagcctttggaagtttttgtttcagagctatgctggaaacagc

SEQ ID NO: 64079 - DNA, 70 bp, Artificial Sequence
  Synthetic
gccaagcatttaggtgacactataggaaaggggagacctctggctgtttcagagctatgctggaaacagc

SEQ ID NO: 64080 - DNA, 70 bp, Artificial Sequence
  Synthetic
gccaagcatttaggtgacactatagagtgttatttaacgtagccagtttcagagctatgctggaaacagc

SEQ ID NO: 64081 - DNA, 70 bp, Artificial Sequence
  Synthetic
gccaagcatttaggtgacactatagcacaagtgagtcagcgtccagtttcagagctatgctggaaacagc

SEQ ID NO: 64082 - DNA, 70 bp, Artificial Sequence
  Synthetic
gccaagcatttaggtgacactatagccacctgtcttactagttaggtttcagagctatgctggaaacagc

SEQ ID NO: 64083 - DNA, 70 bp, Artificial Sequence
  Synthetic
gccaagcatttaggtgacactatagcaccaatcctcctagttcgtgtttcagagctatgctggaaacagc

SEQ ID NO: 64084 - DNA, 70 bp, Artificial Sequence
  Synthetic
gccaagcatttaggtgacactatagatgtcaaagcctggagttacgtttcagagctatgctggaaacagc

SEQ ID NO: 64085 - DNA, 70 bp, Artificial Sequence
  Synthetic
gccaagcatttaggtgacactatagacactgggctcaggagtagagtttcagagctatgctggaaacagc

SEQ ID NO: 64086 - DNA, 70 bp, Artificial Sequence
  Synthetic
gccaagcatttaggtgacactatagtcctggttctcaggagtagagtttcagagctatgctggaaacagc

SEQ ID NO: 64087 - DNA, 70 bp, Artificial Sequence
  Synthetic
gccaagcatttaggtgacactataggtcctacttgtccggggtgggtttcagagctatgctggaaacagc

SEQ ID NO: 64088 - DNA, 70 bp, Artificial Sequence
  Synthetic
gccaagcatttaggtgacactatagtgttgggcattaggagtagagtttcagagctatgctggaaacagc

SEQ ID NO: 64089 - DNA, 70 bp, Artificial Sequence
  Synthetic
gccaagcatttaggtgacactatagcagcactgcatctagtagtggtttcagagctatgctggaaacagc

SEQ ID NO: 64090 - DNA, 70 bp, Artificial Sequence
  Synthetic
gccaagcatttaggtgacactatagcgctattaccctggggattcgtttcagagctatgctggaaacagc

SEQ ID NO: 64091 - DNA, 70 bp, Artificial Sequence
  Synthetic
gccaagcatttaggtgacactatagcggggcatctgtttcacggcgtttcagagctatgctggaaacagc

SEQ ID NO: 64092 - DNA, 70 bp, Artificial Sequence
  Synthetic
gccaagcatttaggtgacactatagggggcatcacagatcagtgcgtttcagagctatgctggaaacagc

SEQ ID NO: 64093 - DNA, 70 bp, Artificial Sequence
  Synthetic
gccaagcatttaggtgacactatagatggtctcattactcatagcgtttcagagctatgctggaaacagc

SEQ ID NO: 64094 - DNA, 70 bp, Artificial Sequence
  Synthetic
gccaagcatttaggtgacactatagaccacaccaagcccctaggcgtttcagagctatgctggaaacagc

SEQ ID NO: 64095 - DNA, 70 bp, Artificial Sequence
  Synthetic
gccaagcatttaggtgacactatagagtcctccagggggactcaggtttcagagctatgctggaaacagc

SEQ ID NO: 64096 - DNA, 70 bp, Artificial Sequence
  Synthetic
gccaagcatttaggtgacactatagcacttacccagcatgggcgagtttcagagctatgctggaaacagc

SEQ ID NO: 64097 - DNA, 70 bp, Artificial Sequence
  Synthetic
gccaagcatttaggtgacactatagtgtgacacatattgagacttgtttcagagctatgctggaaacagc

SEQ ID NO: 64098 - DNA, 70 bp, Artificial Sequence
  Synthetic
gccaagcatttaggtgacactatagaatggggcttgttctcacaagtttcagagctatgctggaaacagc

SEQ ID NO: 64099 - DNA, 70 bp, Artificial Sequence
  Synthetic
gccaagcatttaggtgacactatagggaaacttaggagacatcgtgtttcagagctatgctggaaacagc

SEQ ID NO: 64100 - DNA, 70 bp, Artificial Sequence
  Synthetic
gccaagcatttaggtgacactatagattcacagaaacagatgtgagtttcagagctatgctggaaacagc

SEQ ID NO: 64101 - DNA, 70 bp, Artificial Sequence
  Synthetic
gccaagcatttaggtgacactatagtcatcagagttttgtcttctgtttcagagctatgctggaaacagc

SEQ ID NO: 64102 - DNA, 70 bp, Artificial Sequence
  Synthetic
gccaagcatttaggtgacactatagagcagggacaggggctgaacgtttcagagctatgctggaaacagc

SEQ ID NO: 64103 - DNA, 70 bp, Artificial Sequence
  Synthetic
gccaagcatttaggtgacactatagtggcgtgcccaccagcaggagtttcagagctatgctggaaacagc

SEQ ID NO: 64104 - DNA, 70 bp, Artificial Sequence
  Synthetic
gccaagcatttaggtgacactatagagactcaaacacagtttcatgtttcagagctatgctggaaacagc

SEQ ID NO: 64105 - DNA, 70 bp, Artificial Sequence
  Synthetic
gccaagcatttaggtgacactatagtcagccccatggattcagacgtttcagagctatgctggaaacagc

SEQ ID NO: 64106 - DNA, 70 bp, Artificial Sequence
  Synthetic
gccaagcatttaggtgacactatagtctctgctgtcaagttcatcgtttcagagctatgctggaaacagc

SEQ ID NO: 64107 - DNA, 70 bp, Artificial Sequence
  Synthetic
gccaagcatttaggtgacactatagtcaacaagtggtgtccagaggtttcagagctatgctggaaacagc

SEQ ID NO: 64108 - DNA, 70 bp, Artificial Sequence
  Synthetic
gccaagcatttaggtgacactatagtcaaggcctttggtcatgtggtttcagagctatgctggaaacagc

SEQ ID NO: 64109 - DNA, 70 bp, Artificial Sequence
  Synthetic
gccaagcatttaggtgacactatagacccaaggaggggctggaaggtttcagagctatgctggaaacagc

SEQ ID NO: 64110 - DNA, 70 bp, Artificial Sequence
  Synthetic
gccaagcatttaggtgacactatagtccagaagaaaatacatggagtttcagagctatgctggaaacagc

SEQ ID NO: 64111 - DNA, 70 bp, Artificial Sequence
  Synthetic
gccaagcatttaggtgacactatagtggcaagaaaggcattagatgtttcagagctatgctggaaacagc

SEQ ID NO: 64112 - DNA, 70 bp, Artificial Sequence
  Synthetic
gccaagcatttaggtgacactatagcccggaaacaagtgtctgaggtttcagagctatgctggaaacagc

SEQ ID NO: 64113 - DNA, 70 bp, Artificial Sequence
  Synthetic
gccaagcatttaggtgacactatagttgtaccattggccgaaagagtttcagagctatgctggaaacagc

SEQ ID NO: 64114 - DNA, 70 bp, Artificial Sequence
  Synthetic
gccaagcatttaggtgacactataggtcaaacagggcactcaggtgtttcagagctatgctggaaacagc

SEQ ID NO: 64115 - DNA, 70 bp, Artificial Sequence
  Synthetic
gccaagcatttaggtgacactatagtgtaagaaagtgtgtcatacgtttcagagctatgctggaaacagc

SEQ ID NO: 64116 - DNA, 70 bp, Artificial Sequence
  Synthetic
gccaagcatttaggtgacactataggctcaagggttcagattctcgtttcagagctatgctggaaacagc

SEQ ID NO: 64117 - DNA, 70 bp, Artificial Sequence
  Synthetic
gccaagcatttaggtgacactatagcaccctgagttatacagactgtttcagagctatgctggaaacagc

SEQ ID NO: 64118 - DNA, 70 bp, Artificial Sequence
  Synthetic
gccaagcatttaggtgacactatagtacaagaaagttgttggagcgtttcagagctatgctggaaacagc

SEQ ID NO: 64119 - DNA, 70 bp, Artificial Sequence
  Synthetic
gccaagcatttaggtgacactatagtacagcagaaattcaggactgtttcagagctatgctggaaacagc

SEQ ID NO: 64120 - DNA, 70 bp, Artificial Sequence
  Synthetic
gccaagcatttaggtgacactatagattgaacatcttcaagtggcgtttcagagctatgctggaaacagc

SEQ ID NO: 64121 - DNA, 70 bp, Artificial Sequence
  Synthetic
gccaagcatttaggtgacactatagttgtaactttatgtcctcaggtttcagagctatgctggaaacagc

SEQ ID NO: 64122 - DNA, 70 bp, Artificial Sequence
  Synthetic
gccaagcatttaggtgacactatagttctctctttagcccattctgtttcagagctatgctggaaacagc

SEQ ID NO: 64123 - DNA, 70 bp, Artificial Sequence
  Synthetic
gccaagcatttaggtgacactatagacatctctcggtttgctcaggtttcagagctatgctggaaacagc

SEQ ID NO: 64124 - DNA, 70 bp, Artificial Sequence
  Synthetic
gccaagcatttaggtgacactatagaccatggacacagacactgagtttcagagctatgctggaaacagc

SEQ ID NO: 64125 - DNA, 70 bp, Artificial Sequence
  Synthetic
gccaagcatttaggtgacactatagacaagactcacatagctatagtttcagagctatgctggaaacagc

SEQ ID NO: 64126 - DNA, 70 bp, Artificial Sequence
  Synthetic
gccaagcatttaggtgacactatagaggcacatggtcagtagtccgtttcagagctatgctggaaacagc

SEQ ID NO: 64127 - DNA, 70 bp, Artificial Sequence
  Synthetic
gccaagcatttaggtgacactatagagaagtttctctcttcattcgtttcagagctatgctggaaacagc

SEQ ID NO: 64128 - DNA, 70 bp, Artificial Sequence
  Synthetic
gccaagcatttaggtgacactataggctgtggggttgggagctaggtttcagagctatgctggaaacagc

SEQ ID NO: 64129 - DNA, 70 bp, Artificial Sequence
  Synthetic
gccaagcatttaggtgacactatagccttctgctgctactcctcagtttcagagctatgctggaaacagc

SEQ ID NO: 64130 - DNA, 70 bp, Artificial Sequence
  Synthetic
gccaagcatttaggtgacactatagtctgggggaggacagtgatggtttcagagctatgctggaaacagc

SEQ ID NO: 64131 - DNA, 70 bp, Artificial Sequence
  Synthetic
gccaagcatttaggtgacactatagaatatccagtcatatccgatgtttcagagctatgctggaaacagc

SEQ ID NO: 64132 - DNA, 70 bp, Artificial Sequence
  Synthetic
gccaagcatttaggtgacactatagaggagtggggatgctagctggtttcagagctatgctggaaacagc

SEQ ID NO: 64133 - DNA, 70 bp, Artificial Sequence
  Synthetic
gccaagcatttaggtgacactatagccatcggactaggtttcattgtttcagagctatgctggaaacagc

SEQ ID NO: 64134 - DNA, 70 bp, Artificial Sequence
  Synthetic
gccaagcatttaggtgacactatagcaggggcgcccgagagtcacgtttcagagctatgctggaaacagc

SEQ ID NO: 64135 - DNA, 70 bp, Artificial Sequence
  Synthetic
gccaagcatttaggtgacactatagtgaggacccgcaggtcaggagtttcagagctatgctggaaacagc

SEQ ID NO: 64136 - DNA, 70 bp, Artificial Sequence
  Synthetic
gccaagcatttaggtgacactatagcataacactgactgcaccacgtttcagagctatgctggaaacagc

SEQ ID NO: 64137 - DNA, 70 bp, Artificial Sequence
  Synthetic
gccaagcatttaggtgacactatagatgatattactctcttcctcgtttcagagctatgctggaaacagc

SEQ ID NO: 64138 - DNA, 70 bp, Artificial Sequence
  Synthetic
gccaagcatttaggtgacactatagacccagacctcacagttctagtttcagagctatgctggaaacagc

SEQ ID NO: 64139 - DNA, 70 bp, Artificial Sequence
  Synthetic
gccaagcatttaggtgacactatagccttggaaacgtgagaaatagtttcagagctatgctggaaacagc

SEQ ID NO: 64140 - DNA, 70 bp, Artificial Sequence
  Synthetic
gccaagcatttaggtgacactatagttcatctgataatattccccgtttcagagctatgctggaaacagc

SEQ ID NO: 64141 - DNA, 70 bp, Artificial Sequence
  Synthetic
gccaagcatttaggtgacactatagcatcttggtttcactgtcgagtttcagagctatgctggaaacagc

SEQ ID NO: 64142 - DNA, 70 bp, Artificial Sequence
  Synthetic
gccaagcatttaggtgacactatagaaggagtcggttctgtgatggtttcagagctatgctggaaacagc

SEQ ID NO: 64143 - DNA, 70 bp, Artificial Sequence
  Synthetic
gccaagcatttaggtgacactatagtgccacggtcgcctctgagagtttcagagctatgctggaaacagc

SEQ ID NO: 64144 - DNA, 70 bp, Artificial Sequence
  Synthetic
gccaagcatttaggtgacactatagggctggtgggcatcattatcgtttcagagctatgctggaaacagc

SEQ ID NO: 64145 - DNA, 70 bp, Artificial Sequence
  Synthetic
gccaagcatttaggtgacactatagcaacgagagtgctatgtgaggtttcagagctatgctggaaacagc

SEQ ID NO: 64146 - DNA, 70 bp, Artificial Sequence
  Synthetic
gccaagcatttaggtgacactatagagctccgcaggctcagacatgtttcagagctatgctggaaacagc

SEQ ID NO: 64147 - DNA, 70 bp, Artificial Sequence
  Synthetic
gccaagcatttaggtgacactatagccaaagggtcctggctgaatgtttcagagctatgctggaaacagc

SEQ ID NO: 64148 - DNA, 70 bp, Artificial Sequence
  Synthetic
gccaagcatttaggtgacactatagcgttcaagtggagcaggatggtttcagagctatgctggaaacagc

SEQ ID NO: 64149 - DNA, 70 bp, Artificial Sequence
  Synthetic
gccaagcatttaggtgacactatagtcaaacagcttcacattctggtttcagagctatgctggaaacagc

SEQ ID NO: 64150 - DNA, 70 bp, Artificial Sequence
  Synthetic
gccaagcatttaggtgacactatagagacaaatcacacatatggagtttcagagctatgctggaaacagc

SEQ ID NO: 64151 - DNA, 70 bp, Artificial Sequence
  Synthetic
gccaagcatttaggtgacactatagacatctctctcaggtgcccggtttcagagctatgctggaaacagc

SEQ ID NO: 64152 - DNA, 70 bp, Artificial Sequence
  Synthetic
gccaagcatttaggtgacactatagtgaaggacgccgagaaccttgtttcagagctatgctggaaacagc

SEQ ID NO: 64153 - DNA, 70 bp, Artificial Sequence
  Synthetic
gccaagcatttaggtgacactataggcctgacaccatcaaggatggtttcagagctatgctggaaacagc

SEQ ID NO: 64154 - DNA, 70 bp, Artificial Sequence
  Synthetic
gccaagcatttaggtgacactatagcaggcacaatttctagagcggtttcagagctatgctggaaacagc

SEQ ID NO: 64155 - DNA, 70 bp, Artificial Sequence
  Synthetic
gccaagcatttaggtgacactatagcccaggaggctaaaactgtggtttcagagctatgctggaaacagc

SEQ ID NO: 64156 - DNA, 70 bp, Artificial Sequence
  Synthetic
gccaagcatttaggtgacactataggaagtatgtgctgctcacaagtttcagagctatgctggaaacagc

SEQ ID NO: 64157 - DNA, 70 bp, Artificial Sequence
  Synthetic
gccaagcatttaggtgacactatagacatcatctgatgatgtctggtttcagagctatgctggaaacagc

SEQ ID NO: 64158 - DNA, 70 bp, Artificial Sequence
  Synthetic
gccaagcatttaggtgacactatagagggagtgagagtgaggaaggtttcagagctatgctggaaacagc

SEQ ID NO: 64159 - DNA, 70 bp, Artificial Sequence
  Synthetic
gccaagcatttaggtgacactatagacccccagggattctggtctgtttcagagctatgctggaaacagc

SEQ ID NO: 64160 - DNA, 70 bp, Artificial Sequence
  Synthetic
gccaagcatttaggtgacactatagggtactcagaggccgctcaggtttcagagctatgctggaaacagc

SEQ ID NO: 64161 - DNA, 70 bp, Artificial Sequence
  Synthetic
gccaagcatttaggtgacactatagtgtgtctgggcagcggtcacgtttcagagctatgctggaaacagc

SEQ ID NO: 64162 - DNA, 70 bp, Artificial Sequence
  Synthetic
gccaagcatttaggtgacactatagtgctgcagagagcagaactggtttcagagctatgctggaaacagc

SEQ ID NO: 64163 - DNA, 70 bp, Artificial Sequence
  Synthetic
gccaagcatttaggtgacactatagggtctctcttcttagttcaagtttcagagctatgctggaaacagc

SEQ ID NO: 64164 - DNA, 70 bp, Artificial Sequence
  Synthetic
gccaagcatttaggtgacactatagcaagagaggactttcagctcgtttcagagctatgctggaaacagc

SEQ ID NO: 64165 - DNA, 70 bp, Artificial Sequence
  Synthetic
gccaagcatttaggtgacactatagggcatgaaggccatgtagccgtttcagagctatgctggaaacagc

SEQ ID NO: 64166 - DNA, 70 bp, Artificial Sequence
  Synthetic
gccaagcatttaggtgacactatagtcctgctcatgctgctctacgtttcagagctatgctggaaacagc

SEQ ID NO: 64167 - DNA, 70 bp, Artificial Sequence
  Synthetic
gccaagcatttaggtgacactatagtcctaacaccatccaggatggtttcagagctatgctggaaacagc

SEQ ID NO: 64168 - DNA, 70 bp, Artificial Sequence
  Synthetic
gccaagcatttaggtgacactatagtgcttctcaggtgacacaatgtttcagagctatgctggaaacagc

SEQ ID NO: 64169 - DNA, 70 bp, Artificial Sequence
  Synthetic
gccaagcatttaggtgacactatagtcagaggagctctgtgctatgtttcagagctatgctggaaacagc

SEQ ID NO: 64170 - DNA, 70 bp, Artificial Sequence
  Synthetic
gccaagcatttaggtgacactataggtctttgtcgggggcctcaagtttcagagctatgctggaaacagc

SEQ ID NO: 64171 - DNA, 70 bp, Artificial Sequence
  Synthetic
gccaagcatttaggtgacactatagcaggcaggactagtgctgctgtttcagagctatgctggaaacagc

SEQ ID NO: 64172 - DNA, 70 bp, Artificial Sequence
  Synthetic
gccaagcatttaggtgacactatagggagacagaagaaaatcccagtttcagagctatgctggaaacagc

SEQ ID NO: 64173 - DNA, 70 bp, Artificial Sequence
  Synthetic
gccaagcatttaggtgacactatagttactggaagcgatgttagagtttcagagctatgctggaaacagc

SEQ ID NO: 64174 - DNA, 70 bp, Artificial Sequence
  Synthetic
gccaagcatttaggtgacactatagcaagagaagaatggactctggtttcagagctatgctggaaacagc

SEQ ID NO: 64175 - DNA, 70 bp, Artificial Sequence
  Synthetic
gccaagcatttaggtgacactatagaagcaggtccagaactaagtgtttcagagctatgctggaaacagc

SEQ ID NO: 64176 - DNA, 70 bp, Artificial Sequence
  Synthetic
gccaagcatttaggtgacactatagggggttccgttgtcctcagcgtttcagagctatgctggaaacagc

SEQ ID NO: 64177 - DNA, 70 bp, Artificial Sequence
  Synthetic
gccaagcatttaggtgacactataggtggaagtgacgcagttttagtttcagagctatgctggaaacagc

SEQ ID NO: 64178 - DNA, 70 bp, Artificial Sequence
  Synthetic
gccaagcatttaggtgacactatagggaagtcatttttcagacctgtttcagagctatgctggaaacagc

SEQ ID NO: 64179 - DNA, 70 bp, Artificial Sequence
  Synthetic
gccaagcatttaggtgacactataggcacagcaaaggctatcccggtttcagagctatgctggaaacagc

SEQ ID NO: 64180 - DNA, 70 bp, Artificial Sequence
  Synthetic
gccaagcatttaggtgacactataggtaggcgttctggtcatttcgtttcagagctatgctggaaacagc

SEQ ID NO: 64181 - DNA, 70 bp, Artificial Sequence
  Synthetic
gccaagcatttaggtgacactatagagcatggtgctattcactaagtttcagagctatgctggaaacagc

SEQ ID NO: 64182 - DNA, 70 bp, Artificial Sequence
  Synthetic
gccaagcatttaggtgacactatagtgactgattcagacagatacgtttcagagctatgctggaaacagc

SEQ ID NO: 64183 - DNA, 70 bp, Artificial Sequence
  Synthetic
gccaagcatttaggtgacactatagatgccccgtctccatctagcgtttcagagctatgctggaaacagc

SEQ ID NO: 64184 - DNA, 70 bp, Artificial Sequence
  Synthetic
gccaagcatttaggtgacactataggtgggcacccggcggctcaggtttcagagctatgctggaaacagc

SEQ ID NO: 64185 - DNA, 70 bp, Artificial Sequence
  Synthetic
gccaagcatttaggtgacactatagctcagcgctaatcgtcttccgtttcagagctatgctggaaacagc

SEQ ID NO: 64186 - DNA, 70 bp, Artificial Sequence
  Synthetic
gccaagcatttaggtgacactatagaataaaataaggggctgtgggtttcagagctatgctggaaacagc

SEQ ID NO: 64187 - DNA, 70 bp, Artificial Sequence
  Synthetic
gccaagcatttaggtgacactataggctcaacaaagtgtggaagagtttcagagctatgctggaaacagc

SEQ ID NO: 64188 - DNA, 70 bp, Artificial Sequence
  Synthetic
gccaagcatttaggtgacactatagattcccacggctggtcaggagtttcagagctatgctggaaacagc

SEQ ID NO: 64189 - DNA, 70 bp, Artificial Sequence
  Synthetic
gccaagcatttaggtgacactatagcgaagtgcagagctagcactgtttcagagctatgctggaaacagc

SEQ ID NO: 64190 - DNA, 70 bp, Artificial Sequence
  Synthetic
gccaagcatttaggtgacactatagctcttcctcagtggctgaaggtttcagagctatgctggaaacagc

SEQ ID NO: 64191 - DNA, 70 bp, Artificial Sequence
  Synthetic
gccaagcatttaggtgacactatagacagttgtctcatcactgaggtttcagagctatgctggaaacagc

SEQ ID NO: 64192 - DNA, 70 bp, Artificial Sequence
  Synthetic
gccaagcatttaggtgacactatagcccagggctgatcttcctatgtttcagagctatgctggaaacagc

SEQ ID NO: 64193 - DNA, 70 bp, Artificial Sequence
  Synthetic
gccaagcatttaggtgacactatagttacatacgagcagctaaaggtttcagagctatgctggaaacagc

SEQ ID NO: 64194 - DNA, 70 bp, Artificial Sequence
  Synthetic
gccaagcatttaggtgacactatagcacttcagtatgcttccaacgtttcagagctatgctggaaacagc

SEQ ID NO: 64195 - DNA, 70 bp, Artificial Sequence
  Synthetic
gccaagcatttaggtgacactatagattcgaaaaggactctatcggtttcagagctatgctggaaacagc

SEQ ID NO: 64196 - DNA, 70 bp, Artificial Sequence
  Synthetic
gccaagcatttaggtgacactatagctgtattccctctcaagcaggtttcagagctatgctggaaacagc

SEQ ID NO: 64197 - DNA, 70 bp, Artificial Sequence
  Synthetic
gccaagcatttaggtgacactatagtacaggcacttttcaaattcgtttcagagctatgctggaaacagc

SEQ ID NO: 64198 - DNA, 70 bp, Artificial Sequence
  Synthetic
gccaagcatttaggtgacactatagatgggaaggcgtctcagtgtgtttcagagctatgctggaaacagc

SEQ ID NO: 64199 - DNA, 70 bp, Artificial Sequence
  Synthetic
gccaagcatttaggtgacactatagggggtctattttattgggatgtttcagagctatgctggaaacagc

SEQ ID NO: 64200 - DNA, 70 bp, Artificial Sequence
  Synthetic
gccaagcatttaggtgacactataggtccttcctgcactcagcgcgtttcagagctatgctggaaacagc

SEQ ID NO: 64201 - DNA, 70 bp, Artificial Sequence
  Synthetic
gccaagcatttaggtgacactatagttgtggcctacgaatacagcgtttcagagctatgctggaaacagc

SEQ ID NO: 64202 - DNA, 70 bp, Artificial Sequence
  Synthetic
gccaagcatttaggtgacactatagtgggccacccccaacttgtggtttcagagctatgctggaaacagc

SEQ ID NO: 64203 - DNA, 70 bp, Artificial Sequence
  Synthetic
gccaagcatttaggtgacactatagattcatggcttcaagagaacgtttcagagctatgctggaaacagc

SEQ ID NO: 64204 - DNA, 70 bp, Artificial Sequence
  Synthetic
gccaagcatttaggtgacactataggttctcttgaagccatgaatgtttcagagctatgctggaaacagc

SEQ ID NO: 64205 - DNA, 70 bp, Artificial Sequence
  Synthetic
gccaagcatttaggtgacactataggcgggtgctgggctcaggccgtttcagagctatgctggaaacagc

SEQ ID NO: 64206 - DNA, 70 bp, Artificial Sequence
  Synthetic
gccaagcatttaggtgacactatagcgggctccgggtccctcaccgtttcagagctatgctggaaacagc

SEQ ID NO: 64207 - DNA, 70 bp, Artificial Sequence
  Synthetic
gccaagcatttaggtgacactatagtgctgtaggcatcagttatggtttcagagctatgctggaaacagc

SEQ ID NO: 64208 - DNA, 70 bp, Artificial Sequence
  Synthetic
gccaagcatttaggtgacactatagggcgtgcagtcgcggtgacggtttcagagctatgctggaaacagc

SEQ ID NO: 64209 - DNA, 70 bp, Artificial Sequence
  Synthetic
gccaagcatttaggtgacactatagcacagcttgctgttggaagtgtttcagagctatgctggaaacagc

SEQ ID NO: 64210 - DNA, 70 bp, Artificial Sequence
  Synthetic
gccaagcatttaggtgacactatagaatgctgtgcggggtctcatgtttcagagctatgctggaaacagc

SEQ ID NO: 64211 - DNA, 70 bp, Artificial Sequence
  Synthetic
gccaagcatttaggtgacactatagattcaggctgttcaaggtgagtttcagagctatgctggaaacagc

SEQ ID NO: 64212 - DNA, 70 bp, Artificial Sequence
  Synthetic
gccaagcatttaggtgacactatagccccttggtcaatggtgttcgtttcagagctatgctggaaacagc

SEQ ID NO: 64213 - DNA, 70 bp, Artificial Sequence
  Synthetic
gccaagcatttaggtgacactatagaggcaagaagagtggagggcgtttcagagctatgctggaaacagc

SEQ ID NO: 64214 - DNA, 70 bp, Artificial Sequence
  Synthetic
gccaagcatttaggtgacactatagctgtggagtctatcagacgtgtttcagagctatgctggaaacagc

SEQ ID NO: 64215 - DNA, 70 bp, Artificial Sequence
  Synthetic
gccaagcatttaggtgacactataggagggcggggtgagcgtcacgtttcagagctatgctggaaacagc

SEQ ID NO: 64216 - DNA, 70 bp, Artificial Sequence
  Synthetic
gccaagcatttaggtgacactatagagtctctgaagaagaagcttgtttcagagctatgctggaaacagc

SEQ ID NO: 64217 - DNA, 70 bp, Artificial Sequence
  Synthetic
gccaagcatttaggtgacactatagatacgagcagttgaagaaatgtttcagagctatgctggaaacagc

SEQ ID NO: 64218 - DNA, 70 bp, Artificial Sequence
  Synthetic
gccaagcatttaggtgacactataggatattggtggtaggtaatcgtttcagagctatgctggaaacagc

SEQ ID NO: 64219 - DNA, 70 bp, Artificial Sequence
  Synthetic
gccaagcatttaggtgacactatagtagaagacgtatgatgatgcgtttcagagctatgctggaaacagc

SEQ ID NO: 64220 - DNA, 70 bp, Artificial Sequence
  Synthetic
gccaagcatttaggtgacactatagagcctgctgtattacctttggtttcagagctatgctggaaacagc

SEQ ID NO: 64221 - DNA, 70 bp, Artificial Sequence
  Synthetic
gccaagcatttaggtgacactatagagaagaccgtactcagtaacgtttcagagctatgctggaaacagc

SEQ ID NO: 64222 - DNA, 70 bp, Artificial Sequence
  Synthetic
gccaagcatttaggtgacactataggctgggcgggcccagcacaagtttcagagctatgctggaaacagc

SEQ ID NO: 64223 - DNA, 70 bp, Artificial Sequence
  Synthetic
gccaagcatttaggtgacactatagacgggcgggtatctcatgacgtttcagagctatgctggaaacagc

SEQ ID NO: 64224 - DNA, 70 bp, Artificial Sequence
  Synthetic
gccaagcatttaggtgacactatagatttagtgtctgtgtagtaggtttcagagctatgctggaaacagc

SEQ ID NO: 64225 - DNA, 70 bp, Artificial Sequence
  Synthetic
gccaagcatttaggtgacactatagttggtggtttacctactcaagtttcagagctatgctggaaacagc

SEQ ID NO: 64226 - DNA, 70 bp, Artificial Sequence
  Synthetic
gccaagcatttaggtgacactatagaaaatcgagctccatactaagtttcagagctatgctggaaacagc

SEQ ID NO: 64227 - DNA, 70 bp, Artificial Sequence
  Synthetic
gccaagcatttaggtgacactatagcctctcttggtcaggacttcgtttcagagctatgctggaaacagc

SEQ ID NO: 64228 - DNA, 70 bp, Artificial Sequence
  Synthetic
gccaagcatttaggtgacactatagcggcttctgggcggctgaaagtttcagagctatgctggaaacagc

SEQ ID NO: 64229 - DNA, 70 bp, Artificial Sequence
  Synthetic
gccaagcatttaggtgacactatagcatgggcggtgcttttgtatgtttcagagctatgctggaaacagc

SEQ ID NO: 64230 - DNA, 70 bp, Artificial Sequence
  Synthetic
gccaagcatttaggtgacactatagtccagaaacaaaatgttcgagtttcagagctatgctggaaacagc

SEQ ID NO: 64231 - DNA, 70 bp, Artificial Sequence
  Synthetic
gccaagcatttaggtgacactataggaagaaaaccctgggcatatgtttcagagctatgctggaaacagc

SEQ ID NO: 64232 - DNA, 70 bp, Artificial Sequence
  Synthetic
gccaagcatttaggtgacactataggaccctcatcaaccccatgggtttcagagctatgctggaaacagc

SEQ ID NO: 64233 - DNA, 70 bp, Artificial Sequence
  Synthetic
gccaagcatttaggtgacactatagtgcggcacctgcagagctaggtttcagagctatgctggaaacagc

SEQ ID NO: 64234 - DNA, 70 bp, Artificial Sequence
  Synthetic
gccaagcatttaggtgacactatagagagttggttttttaggcttgtttcagagctatgctggaaacagc

SEQ ID NO: 64235 - DNA, 70 bp, Artificial Sequence
  Synthetic
gccaagcatttaggtgacactatagagctggtggactcgagacacgtttcagagctatgctggaaacagc

SEQ ID NO: 64236 - DNA, 70 bp, Artificial Sequence
  Synthetic
gccaagcatttaggtgacactataggaatatctcctccgctggtggtttcagagctatgctggaaacagc

SEQ ID NO: 64237 - DNA, 70 bp, Artificial Sequence
  Synthetic
gccaagcatttaggtgacactatagaggcaggaggaaggagtgttgtttcagagctatgctggaaacagc

SEQ ID NO: 64238 - DNA, 70 bp, Artificial Sequence
  Synthetic
gccaagcatttaggtgacactatagccggggtctgctcacatagcgtttcagagctatgctggaaacagc

SEQ ID NO: 64239 - DNA, 70 bp, Artificial Sequence
  Synthetic
gccaagcatttaggtgacactatagccggcttgctttctcagctagtttcagagctatgctggaaacagc

SEQ ID NO: 64240 - DNA, 70 bp, Artificial Sequence
  Synthetic
gccaagcatttaggtgacactatagcttatgggctcgtcactgcggtttcagagctatgctggaaacagc

SEQ ID NO: 64241 - DNA, 70 bp, Artificial Sequence
  Synthetic
gccaagcatttaggtgacactataggggcttcacatgcagagatggtttcagagctatgctggaaacagc

SEQ ID NO: 64242 - DNA, 70 bp, Artificial Sequence
  Synthetic
gccaagcatttaggtgacactatagaatgttctcagaggcatggggtttcagagctatgctggaaacagc

SEQ ID NO: 64243 - DNA, 70 bp, Artificial Sequence
  Synthetic
gccaagcatttaggtgacactatagcatcggtccctcatctcttggtttcagagctatgctggaaacagc

SEQ ID NO: 64244 - DNA, 70 bp, Artificial Sequence
  Synthetic
gccaagcatttaggtgacactataggtcagtcttcagctctttccgtttcagagctatgctggaaacagc

SEQ ID NO: 64245 - DNA, 70 bp, Artificial Sequence
  Synthetic
gccaagcatttaggtgacactatagagctcaagaaggtgatctaagtttcagagctatgctggaaacagc

SEQ ID NO: 64246 - DNA, 70 bp, Artificial Sequence
  Synthetic
gccaagcatttaggtgacactatagaccgatgcccatctgtagcagtttcagagctatgctggaaacagc

SEQ ID NO: 64247 - DNA, 70 bp, Artificial Sequence
  Synthetic
gccaagcatttaggtgacactataggcaggaacttctggaagagggtttcagagctatgctggaaacagc

SEQ ID NO: 64248 - DNA, 70 bp, Artificial Sequence
  Synthetic
gccaagcatttaggtgacactataggcactgggctgcggcaagtggtttcagagctatgctggaaacagc

SEQ ID NO: 64249 - DNA, 70 bp, Artificial Sequence
  Synthetic
gccaagcatttaggtgacactataggccctgctcaaggcataatggtttcagagctatgctggaaacagc

SEQ ID NO: 64250 - DNA, 70 bp, Artificial Sequence
  Synthetic
gccaagcatttaggtgacactatagactactaagactcagaccatgtttcagagctatgctggaaacagc

SEQ ID NO: 64251 - DNA, 70 bp, Artificial Sequence
  Synthetic
gccaagcatttaggtgacactatagattacgtaatcgggtatatggtttcagagctatgctggaaacagc

SEQ ID NO: 64252 - DNA, 70 bp, Artificial Sequence
  Synthetic
gccaagcatttaggtgacactatagagaacttgatgtccaggatggtttcagagctatgctggaaacagc

SEQ ID NO: 64253 - DNA, 70 bp, Artificial Sequence
  Synthetic
gccaagcatttaggtgacactataggaggtcctcatctatgcctcgtttcagagctatgctggaaacagc

SEQ ID NO: 64254 - DNA, 70 bp, Artificial Sequence
  Synthetic
gccaagcatttaggtgacactatagccagaagatggagaccgtaggtttcagagctatgctggaaacagc

SEQ ID NO: 64255 - DNA, 70 bp, Artificial Sequence
  Synthetic
gccaagcatttaggtgacactatagttggagtgaaaactctggcagtttcagagctatgctggaaacagc

SEQ ID NO: 64256 - DNA, 70 bp, Artificial Sequence
  Synthetic
gccaagcatttaggtgacactataggatgtagcatgttcagagtcgtttcagagctatgctggaaacagc

SEQ ID NO: 64257 - DNA, 70 bp, Artificial Sequence
  Synthetic
gccaagcatttaggtgacactatagaagggtctcagacttcactggtttcagagctatgctggaaacagc

SEQ ID NO: 64258 - DNA, 70 bp, Artificial Sequence
  Synthetic
gccaagcatttaggtgacactatagcaaccacccaatcctcagaggtttcagagctatgctggaaacagc

SEQ ID NO: 64259 - DNA, 70 bp, Artificial Sequence
  Synthetic
gccaagcatttaggtgacactatagcaacagcaatgaagatgtctgtttcagagctatgctggaaacagc

SEQ ID NO: 64260 - DNA, 70 bp, Artificial Sequence
  Synthetic
gccaagcatttaggtgacactatagaggactggctgagccctcacgtttcagagctatgctggaaacagc

SEQ ID NO: 64261 - DNA, 70 bp, Artificial Sequence
  Synthetic
gccaagcatttaggtgacactataggtcaggctgtcacggacatagtttcagagctatgctggaaacagc

SEQ ID NO: 64262 - DNA, 70 bp, Artificial Sequence
  Synthetic
gccaagcatttaggtgacactatagcagtagaggaacagcttcaggtttcagagctatgctggaaacagc

SEQ ID NO: 64263 - DNA, 70 bp, Artificial Sequence
  Synthetic
gccaagcatttaggtgacactatagctgggaatattcagagtttcgtttcagagctatgctggaaacagc

SEQ ID NO: 64264 - DNA, 70 bp, Artificial Sequence
  Synthetic
gccaagcatttaggtgacactataggtggaagttctcagattcgagtttcagagctatgctggaaacagc

SEQ ID NO: 64265 - DNA, 70 bp, Artificial Sequence
  Synthetic
gccaagcatttaggtgacactatagcagccgcatccaggcaggcggtttcagagctatgctggaaacagc

SEQ ID NO: 64266 - DNA, 70 bp, Artificial Sequence
  Synthetic
gccaagcatttaggtgacactataggccaggtgatcagagcctccgtttcagagctatgctggaaacagc

SEQ ID NO: 64267 - DNA, 70 bp, Artificial Sequence
  Synthetic
gccaagcatttaggtgacactataggtcttatgttctactgaccagtttcagagctatgctggaaacagc

SEQ ID NO: 64268 - DNA, 70 bp, Artificial Sequence
  Synthetic
gccaagcatttaggtgacactatagcagtaggatcatttaaggccgtttcagagctatgctggaaacagc

SEQ ID NO: 64269 - DNA, 70 bp, Artificial Sequence
  Synthetic
gccaagcatttaggtgacactatagcacacgatctgtgcacagtggtttcagagctatgctggaaacagc

SEQ ID NO: 64270 - DNA, 70 bp, Artificial Sequence
  Synthetic
gccaagcatttaggtgacactatagcctgccgagtcccagccctggtttcagagctatgctggaaacagc

SEQ ID NO: 64271 - DNA, 70 bp, Artificial Sequence
  Synthetic
gccaagcatttaggtgacactatagctttttgtctcacactgtccgtttcagagctatgctggaaacagc

SEQ ID NO: 64272 - DNA, 70 bp, Artificial Sequence
  Synthetic
gccaagcatttaggtgacactatagaacaataccgtctgtgcctagtttcagagctatgctggaaacagc

SEQ ID NO: 64273 - DNA, 70 bp, Artificial Sequence
  Synthetic
gccaagcatttaggtgacactatagcatcgacctttaactgcaatgtttcagagctatgctggaaacagc

SEQ ID NO: 64274 - DNA, 70 bp, Artificial Sequence
  Synthetic
gccaagcatttaggtgacactatagtcctttgtcacacaattgccgtttcagagctatgctggaaacagc

SEQ ID NO: 64275 - DNA, 70 bp, Artificial Sequence
  Synthetic
gccaagcatttaggtgacactatagctgctctttgccgtttctaagtttcagagctatgctggaaacagc

SEQ ID NO: 64276 - DNA, 70 bp, Artificial Sequence
  Synthetic
gccaagcatttaggtgacactatagttcaaggcgctgctctgaaggtttcagagctatgctggaaacagc

SEQ ID NO: 64277 - DNA, 70 bp, Artificial Sequence
  Synthetic
gccaagcatttaggtgacactatagctggtgcacctcatctagaagtttcagagctatgctggaaacagc

SEQ ID NO: 64278 - DNA, 70 bp, Artificial Sequence
  Synthetic
gccaagcatttaggtgacactatagggctggagtatgccaggtgagtttcagagctatgctggaaacagc

SEQ ID NO: 64279 - DNA, 70 bp, Artificial Sequence
  Synthetic
gccaagcatttaggtgacactatagagtgggcggggctggctcaggtttcagagctatgctggaaacagc

SEQ ID NO: 64280 - DNA, 70 bp, Artificial Sequence
  Synthetic
gccaagcatttaggtgacactataggatctggggcgactcacactgtttcagagctatgctggaaacagc

SEQ ID NO: 64281 - DNA, 70 bp, Artificial Sequence
  Synthetic
gccaagcatttaggtgacactatagaggcagacggattcctcagggtttcagagctatgctggaaacagc

SEQ ID NO: 64282 - DNA, 70 bp, Artificial Sequence
  Synthetic
gccaagcatttaggtgacactatagcctcctgcattcctcatttagtttcagagctatgctggaaacagc

SEQ ID NO: 64283 - DNA, 70 bp, Artificial Sequence
  Synthetic
gccaagcatttaggtgacactataggggactagagttctgttgacgtttcagagctatgctggaaacagc

SEQ ID NO: 64284 - DNA, 70 bp, Artificial Sequence
  Synthetic
gccaagcatttaggtgacactatagagctttctccagagacctaagtttcagagctatgctggaaacagc

SEQ ID NO: 64285 - DNA, 70 bp, Artificial Sequence
  Synthetic
gccaagcatttaggtgacactatagtgacaatgatgcttctgatggtttcagagctatgctggaaacagc

SEQ ID NO: 64286 - DNA, 70 bp, Artificial Sequence
  Synthetic
gccaagcatttaggtgacactatagaggaggcatgacttagacatgtttcagagctatgctggaaacagc

SEQ ID NO: 64287 - DNA, 70 bp, Artificial Sequence
  Synthetic
gccaagcatttaggtgacactatagacacagtctctgtagctcctgtttcagagctatgctggaaacagc

SEQ ID NO: 64288 - DNA, 70 bp, Artificial Sequence
  Synthetic
gccaagcatttaggtgacactatagaggaggcacgacttagacatgtttcagagctatgctggaaacagc

SEQ ID NO: 64289 - DNA, 70 bp, Artificial Sequence
  Synthetic
gccaagcatttaggtgacactataggccagatgagaacgactgaggtttcagagctatgctggaaacagc

SEQ ID NO: 64290 - DNA, 70 bp, Artificial Sequence
  Synthetic
gccaagcatttaggtgacactataggaacgagccggacttagtccgtttcagagctatgctggaaacagc

SEQ ID NO: 64291 - DNA, 70 bp, Artificial Sequence
  Synthetic
gccaagcatttaggtgacactatagagagcttccacctgtcacttgtttcagagctatgctggaaacagc

SEQ ID NO: 64292 - DNA, 70 bp, Artificial Sequence
  Synthetic
gccaagcatttaggtgacactatagctgtcccgagccaacatagcgtttcagagctatgctggaaacagc

SEQ ID NO: 64293 - DNA, 70 bp, Artificial Sequence
  Synthetic
gccaagcatttaggtgacactataggagaaggtccttcttgcgctgtttcagagctatgctggaaacagc

SEQ ID NO: 64294 - DNA, 70 bp, Artificial Sequence
  Synthetic
gccaagcatttaggtgacactatagtaaaaggaagtttccttggcgtttcagagctatgctggaaacagc

SEQ ID NO: 64295 - DNA, 70 bp, Artificial Sequence
  Synthetic
gccaagcatttaggtgacactatagggacacagaacaaagtgaaagtttcagagctatgctggaaacagc

SEQ ID NO: 64296 - DNA, 70 bp, Artificial Sequence
  Synthetic
gccaagcatttaggtgacactatagaaatcacagcccattttgaggtttcagagctatgctggaaacagc

SEQ ID NO: 64297 - DNA, 70 bp, Artificial Sequence
  Synthetic
gccaagcatttaggtgacactatagatcgactcagctgtcactgagtttcagagctatgctggaaacagc

SEQ ID NO: 64298 - DNA, 70 bp, Artificial Sequence
  Synthetic
gccaagcatttaggtgacactatagaagactcacaaagatgattcgtttcagagctatgctggaaacagc

SEQ ID NO: 64299 - DNA, 70 bp, Artificial Sequence
  Synthetic
gccaagcatttaggtgacactataggcgttctgttgacataacatgtttcagagctatgctggaaacagc

SEQ ID NO: 64300 - DNA, 70 bp, Artificial Sequence
  Synthetic
gccaagcatttaggtgacactatagctggctgagcagtcagtctggtttcagagctatgctggaaacagc

SEQ ID NO: 64301 - DNA, 70 bp, Artificial Sequence
  Synthetic
gccaagcatttaggtgacactataggcagggccatggctcaggctgtttcagagctatgctggaaacagc

SEQ ID NO: 64302 - DNA, 70 bp, Artificial Sequence
  Synthetic
gccaagcatttaggtgacactataggacggtgcagtgagctatgagtttcagagctatgctggaaacagc

SEQ ID NO: 64303 - DNA, 70 bp, Artificial Sequence
  Synthetic
gccaagcatttaggtgacactatagtcagagttacaggcaagaaggtttcagagctatgctggaaacagc

SEQ ID NO: 64304 - DNA, 70 bp, Artificial Sequence
  Synthetic
gccaagcatttaggtgacactatagaatgatcctaggaaactagtgtttcagagctatgctggaaacagc

SEQ ID NO: 64305 - DNA, 70 bp, Artificial Sequence
  Synthetic
gccaagcatttaggtgacactatagtcactctttgtggaccactagtttcagagctatgctggaaacagc

SEQ ID NO: 64306 - DNA, 70 bp, Artificial Sequence
  Synthetic
gccaagcatttaggtgacactatagtccatgaaatactgcaaagagtttcagagctatgctggaaacagc

SEQ ID NO: 64307 - DNA, 70 bp, Artificial Sequence
  Synthetic
gccaagcatttaggtgacactataggttagagtctatcatggtctgtttcagagctatgctggaaacagc

SEQ ID NO: 64308 - DNA, 70 bp, Artificial Sequence
  Synthetic
gccaagcatttaggtgacactatagcacctgatgctgatgctagggtttcagagctatgctggaaacagc

SEQ ID NO: 64309 - DNA, 70 bp, Artificial Sequence
  Synthetic
gccaagcatttaggtgacactatagggtgtgactgagctagtcacgtttcagagctatgctggaaacagc

SEQ ID NO: 64310 - DNA, 70 bp, Artificial Sequence
  Synthetic
gccaagcatttaggtgacactatagtgaagttcgacatgtagattgtttcagagctatgctggaaacagc

SEQ ID NO: 64311 - DNA, 70 bp, Artificial Sequence
  Synthetic
gccaagcatttaggtgacactataggccatagagtttgatgtcaagtttcagagctatgctggaaacagc

SEQ ID NO: 64312 - DNA, 70 bp, Artificial Sequence
  Synthetic
gccaagcatttaggtgacactatagacttctcagcacagcttagcgtttcagagctatgctggaaacagc

SEQ ID NO: 64313 - DNA, 70 bp, Artificial Sequence
  Synthetic
gccaagcatttaggtgacactatagcgaaccaacgcggaggactagtttcagagctatgctggaaacagc

SEQ ID NO: 64314 - DNA, 70 bp, Artificial Sequence
  Synthetic
gccaagcatttaggtgacactatagcatcttcgtggaaatgcaaagtttcagagctatgctggaaacagc

SEQ ID NO: 64315 - DNA, 70 bp, Artificial Sequence
  Synthetic
gccaagcatttaggtgacactataggtggccggcagggagctcaggtttcagagctatgctggaaacagc

SEQ ID NO: 64316 - DNA, 70 bp, Artificial Sequence
  Synthetic
gccaagcatttaggtgacactatagagtctgggcccacagcctaggtttcagagctatgctggaaacagc

SEQ ID NO: 64317 - DNA, 70 bp, Artificial Sequence
  Synthetic
gccaagcatttaggtgacactatagaatctggggcgtcccctacagtttcagagctatgctggaaacagc

SEQ ID NO: 64318 - DNA, 70 bp, Artificial Sequence
  Synthetic
gccaagcatttaggtgacactatagggcctcccagcagttgtgacgtttcagagctatgctggaaacagc

SEQ ID NO: 64319 - DNA, 70 bp, Artificial Sequence
  Synthetic
gccaagcatttaggtgacactataggcttcaaaggagagagttatgtttcagagctatgctggaaacagc

SEQ ID NO: 64320 - DNA, 70 bp, Artificial Sequence
  Synthetic
gccaagcatttaggtgacactatagccctaatactgatcagagttgtttcagagctatgctggaaacagc

SEQ ID NO: 64321 - DNA, 70 bp, Artificial Sequence
  Synthetic
gccaagcatttaggtgacactatagagtcagtgctggtgaagtgagtttcagagctatgctggaaacagc

SEQ ID NO: 64322 - DNA, 70 bp, Artificial Sequence
  Synthetic
gccaagcatttaggtgacactatagcggctaggaacccttcacctgtttcagagctatgctggaaacagc

SEQ ID NO: 64323 - DNA, 70 bp, Artificial Sequence
  Synthetic
gccaagcatttaggtgacactatagctccagaagtctcagtgaccgtttcagagctatgctggaaacagc

SEQ ID NO: 64324 - DNA, 70 bp, Artificial Sequence
  Synthetic
gccaagcatttaggtgacactatagagtagctgttattacaaggagtttcagagctatgctggaaacagc

SEQ ID NO: 64325 - DNA, 70 bp, Artificial Sequence
  Synthetic
gccaagcatttaggtgacactataggctttagtgggatttcctgcgtttcagagctatgctggaaacagc

SEQ ID NO: 64326 - DNA, 70 bp, Artificial Sequence
  Synthetic
gccaagcatttaggtgacactatagtggaagttgtcagggactaggtttcagagctatgctggaaacagc

SEQ ID NO: 64327 - DNA, 70 bp, Artificial Sequence
  Synthetic
gccaagcatttaggtgacactataggaaaggatccgagatctaaggtttcagagctatgctggaaacagc

SEQ ID NO: 64328 - DNA, 70 bp, Artificial Sequence
  Synthetic
gccaagcatttaggtgacactatagttcatctgactcatcactctgtttcagagctatgctggaaacagc

SEQ ID NO: 64329 - DNA, 70 bp, Artificial Sequence
  Synthetic
gccaagcatttaggtgacactatagggtagtctctctcttcctaggtttcagagctatgctggaaacagc

SEQ ID NO: 64330 - DNA, 70 bp, Artificial Sequence
  Synthetic
gccaagcatttaggtgacactatagctcctgtgcagaaggtttgagtttcagagctatgctggaaacagc

SEQ ID NO: 64331 - DNA, 70 bp, Artificial Sequence
  Synthetic
gccaagcatttaggtgacactatagagcaagaaagtcaaggacgcgtttcagagctatgctggaaacagc

SEQ ID NO: 64332 - DNA, 70 bp, Artificial Sequence
  Synthetic
gccaagcatttaggtgacactatagaaggacagcaagaagaactggtttcagagctatgctggaaacagc

SEQ ID NO: 64333 - DNA, 70 bp, Artificial Sequence
  Synthetic
gccaagcatttaggtgacactatagctgtggtgctcacacccccagtttcagagctatgctggaaacagc

SEQ ID NO: 64334 - DNA, 70 bp, Artificial Sequence
  Synthetic
gccaagcatttaggtgacactatagtggctggtcactgctgccccgtttcagagctatgctggaaacagc

SEQ ID NO: 64335 - DNA, 70 bp, Artificial Sequence
  Synthetic
gccaagcatttaggtgacactatagaagctggacattaaggggaagtttcagagctatgctggaaacagc

SEQ ID NO: 64336 - DNA, 70 bp, Artificial Sequence
  Synthetic
gccaagcatttaggtgacactataggggtgaagaaaacatctgttgtttcagagctatgctggaaacagc

SEQ ID NO: 64337 - DNA, 70 bp, Artificial Sequence
  Synthetic
gccaagcatttaggtgacactataggagttacccagtccttgagagtttcagagctatgctggaaacagc

SEQ ID NO: 64338 - DNA, 70 bp, Artificial Sequence
  Synthetic
gccaagcatttaggtgacactatagttggactctacacatcataggtttcagagctatgctggaaacagc

SEQ ID NO: 64339 - DNA, 70 bp, Artificial Sequence
  Synthetic
gccaagcatttaggtgacactatagagataaacatccgcatttacgtttcagagctatgctggaaacagc

SEQ ID NO: 64340 - DNA, 70 bp, Artificial Sequence
  Synthetic
gccaagcatttaggtgacactatagatgcttcctgcgtcctgagtgtttcagagctatgctggaaacagc

SEQ ID NO: 64341 - DNA, 70 bp, Artificial Sequence
  Synthetic
gccaagcatttaggtgacactatagctgctctcagggatgctgccgtttcagagctatgctggaaacagc

SEQ ID NO: 64342 - DNA, 70 bp, Artificial Sequence
  Synthetic
gccaagcatttaggtgacactatagctggcacaacgtccttaattgtttcagagctatgctggaaacagc

SEQ ID NO: 64343 - DNA, 70 bp, Artificial Sequence
  Synthetic
gccaagcatttaggtgacactatagcagaggactgcagaagtctggtttcagagctatgctggaaacagc

SEQ ID NO: 64344 - DNA, 70 bp, Artificial Sequence
  Synthetic
gccaagcatttaggtgacactatagcaggtctcaaagacccttgcgtttcagagctatgctggaaacagc

SEQ ID NO: 64345 - DNA, 70 bp, Artificial Sequence
  Synthetic
gccaagcatttaggtgacactataggctgggcagggccaggagtggtttcagagctatgctggaaacagc

SEQ ID NO: 64346 - DNA, 70 bp, Artificial Sequence
  Synthetic
gccaagcatttaggtgacactatagcctcatgttcgtgtggcctagtttcagagctatgctggaaacagc

SEQ ID NO: 64347 - DNA, 70 bp, Artificial Sequence
  Synthetic
gccaagcatttaggtgacactatagccactctgctgtcttgtagcgtttcagagctatgctggaaacagc

SEQ ID NO: 64348 - DNA, 70 bp, Artificial Sequence
  Synthetic
gccaagcatttaggtgacactatagttctagaggagtggtgttaggtttcagagctatgctggaaacagc

SEQ ID NO: 64349 - DNA, 70 bp, Artificial Sequence
  Synthetic
gccaagcatttaggtgacactatagataggagtggcatttgcggtgtttcagagctatgctggaaacagc

SEQ ID NO: 64350 - DNA, 70 bp, Artificial Sequence
  Synthetic
gccaagcatttaggtgacactatagtctaatgcgtcttcagatttgtttcagagctatgctggaaacagc

SEQ ID NO: 64351 - DNA, 70 bp, Artificial Sequence
  Synthetic
gccaagcatttaggtgacactatagtctataccactggcttagaggtttcagagctatgctggaaacagc

SEQ ID NO: 64352 - DNA, 70 bp, Artificial Sequence
  Synthetic
gccaagcatttaggtgacactatagaatccatactgaaaactgtggtttcagagctatgctggaaacagc

SEQ ID NO: 64353 - DNA, 70 bp, Artificial Sequence
  Synthetic
gccaagcatttaggtgacactatagcacagtgtttctcaggaggagtttcagagctatgctggaaacagc

SEQ ID NO: 64354 - DNA, 70 bp, Artificial Sequence
  Synthetic
gccaagcatttaggtgacactatagtacagcgaagagacaatctcgtttcagagctatgctggaaacagc

SEQ ID NO: 64355 - DNA, 70 bp, Artificial Sequence
  Synthetic
gccaagcatttaggtgacactatagagcctccagggaacctcagcgtttcagagctatgctggaaacagc

SEQ ID NO: 64356 - DNA, 70 bp, Artificial Sequence
  Synthetic
gccaagcatttaggtgacactatagttcagcaatgatgcttcattgtttcagagctatgctggaaacagc

SEQ ID NO: 64357 - DNA, 70 bp, Artificial Sequence
  Synthetic
gccaagcatttaggtgacactatagtgggagagtctagtatttccgtttcagagctatgctggaaacagc

SEQ ID NO: 64358 - DNA, 70 bp, Artificial Sequence
  Synthetic
gccaagcatttaggtgacactatagtgagaggacagggagggtgggtttcagagctatgctggaaacagc

SEQ ID NO: 64359 - DNA, 70 bp, Artificial Sequence
  Synthetic
gccaagcatttaggtgacactatagtgagaggacagggaaggtgggtttcagagctatgctggaaacagc

SEQ ID NO: 64360 - DNA, 70 bp, Artificial Sequence
  Synthetic
gccaagcatttaggtgacactatagtgagagggaagggaaggtgggtttcagagctatgctggaaacagc

SEQ ID NO: 64361 - DNA, 70 bp, Artificial Sequence
  Synthetic
gccaagcatttaggtgacactatagcctgtttgtgcgcacagtgcgtttcagagctatgctggaaacagc

SEQ ID NO: 64362 - DNA, 70 bp, Artificial Sequence
  Synthetic
gccaagcatttaggtgacactatagtccacctgtgccttcatatagtttcagagctatgctggaaacagc

SEQ ID NO: 64363 - DNA, 70 bp, Artificial Sequence
  Synthetic
gccaagcatttaggtgacactatagtgggctgtaaatccattcacgtttcagagctatgctggaaacagc

SEQ ID NO: 64364 - DNA, 70 bp, Artificial Sequence
  Synthetic
gccaagcatttaggtgacactatagccaactccaccacttttgttgtttcagagctatgctggaaacagc

SEQ ID NO: 64365 - DNA, 70 bp, Artificial Sequence
  Synthetic
gccaagcatttaggtgacactatagtaattatgcatggacacctggtttcagagctatgctggaaacagc

SEQ ID NO: 64366 - DNA, 70 bp, Artificial Sequence
  Synthetic
gccaagcatttaggtgacactatagcctactcccaaagttgtagcgtttcagagctatgctggaaacagc

SEQ ID NO: 64367 - DNA, 70 bp, Artificial Sequence
  Synthetic
gccaagcatttaggtgacactatagctgcccagggtcagctacgggtttcagagctatgctggaaacagc

SEQ ID NO: 64368 - DNA, 70 bp, Artificial Sequence
  Synthetic
gccaagcatttaggtgacactataggaggaaaatactatcactgggtttcagagctatgctggaaacagc

SEQ ID NO: 64369 - DNA, 70 bp, Artificial Sequence
  Synthetic
gccaagcatttaggtgacactatagtgtccctgagcagaggcagcgtttcagagctatgctggaaacagc

SEQ ID NO: 64370 - DNA, 70 bp, Artificial Sequence
  Synthetic
gccaagcatttaggtgacactatagtcacatattgagggagtgacgtttcagagctatgctggaaacagc

SEQ ID NO: 64371 - DNA, 70 bp, Artificial Sequence
  Synthetic
gccaagcatttaggtgacactatagtcactgctggtcagcatctcgtttcagagctatgctggaaacagc

SEQ ID NO: 64372 - DNA, 70 bp, Artificial Sequence
  Synthetic
gccaagcatttaggtgacactatagctctcttcactcagccttctgtttcagagctatgctggaaacagc

SEQ ID NO: 64373 - DNA, 70 bp, Artificial Sequence
  Synthetic
gccaagcatttaggtgacactatagatcttgtgttctctggattcgtttcagagctatgctggaaacagc

SEQ ID NO: 64374 - DNA, 70 bp, Artificial Sequence
  Synthetic
gccaagcatttaggtgacactatagtttttctcggcgggtttcaggtttcagagctatgctggaaacagc

SEQ ID NO: 64375 - DNA, 70 bp, Artificial Sequence
  Synthetic
gccaagcatttaggtgacactatagagcaggtgctaggactcctcgtttcagagctatgctggaaacagc

SEQ ID NO: 64376 - DNA, 70 bp, Artificial Sequence
  Synthetic
gccaagcatttaggtgacactatagcaatgccgcaggtgttttaagtttcagagctatgctggaaacagc

SEQ ID NO: 64377 - DNA, 70 bp, Artificial Sequence
  Synthetic
gccaagcatttaggtgacactatagctgctgaacatgagactctggtttcagagctatgctggaaacagc

SEQ ID NO: 64378 - DNA, 70 bp, Artificial Sequence
  Synthetic
gccaagcatttaggtgacactataggtttgagtggtgccaattaagtttcagagctatgctggaaacagc

SEQ ID NO: 64379 - DNA, 70 bp, Artificial Sequence
  Synthetic
gccaagcatttaggtgacactatagcaggatgagggtcaccctaggtttcagagctatgctggaaacagc

SEQ ID NO: 64380 - DNA, 70 bp, Artificial Sequence
  Synthetic
gccaagcatttaggtgacactatagttccttgtgttagtgatgctgtttcagagctatgctggaaacagc

SEQ ID NO: 64381 - DNA, 70 bp, Artificial Sequence
  Synthetic
gccaagcatttaggtgacactatagcgcatgtctggacactgatcgtttcagagctatgctggaaacagc

SEQ ID NO: 64382 - DNA, 70 bp, Artificial Sequence
  Synthetic
gccaagcatttaggtgacactataggcattcgttttgctcatcttgtttcagagctatgctggaaacagc

SEQ ID NO: 64383 - DNA, 70 bp, Artificial Sequence
  Synthetic
gccaagcatttaggtgacactatagttgctcacagttctggaggtgtttcagagctatgctggaaacagc

SEQ ID NO: 64384 - DNA, 70 bp, Artificial Sequence
  Synthetic
gccaagcatttaggtgacactatagcgccatctttgtggatctctgtttcagagctatgctggaaacagc

SEQ ID NO: 64385 - DNA, 70 bp, Artificial Sequence
  Synthetic
gccaagcatttaggtgacactataggaatgatcgtggactaagaagtttcagagctatgctggaaacagc

SEQ ID NO: 64386 - DNA, 70 bp, Artificial Sequence
  Synthetic
gccaagcatttaggtgacactatagggtctgggagatgttctgatgtttcagagctatgctggaaacagc

SEQ ID NO: 64387 - DNA, 70 bp, Artificial Sequence
  Synthetic
gccaagcatttaggtgacactatagtttcatcatcattttgggcggtttcagagctatgctggaaacagc

SEQ ID NO: 64388 - DNA, 70 bp, Artificial Sequence
  Synthetic
gccaagcatttaggtgacactataggctcttcatccaaatctagggtttcagagctatgctggaaacagc

SEQ ID NO: 64389 - DNA, 70 bp, Artificial Sequence
  Synthetic
gccaagcatttaggtgacactatagttactgggaaaggtcaaaacgtttcagagctatgctggaaacagc

SEQ ID NO: 64390 - DNA, 70 bp, Artificial Sequence
  Synthetic
gccaagcatttaggtgacactatagctggacgttggcctgggctagtttcagagctatgctggaaacagc

SEQ ID NO: 64391 - DNA, 70 bp, Artificial Sequence
  Synthetic
gccaagcatttaggtgacactataggctcatatatagccaagagcgtttcagagctatgctggaaacagc

SEQ ID NO: 64392 - DNA, 70 bp, Artificial Sequence
  Synthetic
gccaagcatttaggtgacactatagggtgctgttctcgctcttcggtttcagagctatgctggaaacagc

SEQ ID NO: 64393 - DNA, 70 bp, Artificial Sequence
  Synthetic
gccaagcatttaggtgacactataggtcagggagcacgttcaccagtttcagagctatgctggaaacagc

SEQ ID NO: 64394 - DNA, 70 bp, Artificial Sequence
  Synthetic
gccaagcatttaggtgacactatagggacagatccagattgggtagtttcagagctatgctggaaacagc

SEQ ID NO: 64395 - DNA, 70 bp, Artificial Sequence
  Synthetic
gccaagcatttaggtgacactatagacatggctggctcagttactgtttcagagctatgctggaaacagc

SEQ ID NO: 64396 - DNA, 70 bp, Artificial Sequence
  Synthetic
gccaagcatttaggtgacactatagaggaatctctcaggcccacagtttcagagctatgctggaaacagc

SEQ ID NO: 64397 - DNA, 70 bp, Artificial Sequence
  Synthetic
gccaagcatttaggtgacactatagggggtgggcctggcctaatcgtttcagagctatgctggaaacagc

SEQ ID NO: 64398 - DNA, 70 bp, Artificial Sequence
  Synthetic
gccaagcatttaggtgacactatagggtcttcctcaagtggtgaggtttcagagctatgctggaaacagc

SEQ ID NO: 64399 - DNA, 70 bp, Artificial Sequence
  Synthetic
gccaagcatttaggtgacactataggactagggcagggtatcagagtttcagagctatgctggaaacagc

SEQ ID NO: 64400 - DNA, 70 bp, Artificial Sequence
  Synthetic
gccaagcatttaggtgacactataggtgaccactgagggctgatggtttcagagctatgctggaaacagc

SEQ ID NO: 64401 - DNA, 70 bp, Artificial Sequence
  Synthetic
gccaagcatttaggtgacactataggctgggatgcttttgggtttgtttcagagctatgctggaaacagc

SEQ ID NO: 64402 - DNA, 70 bp, Artificial Sequence
  Synthetic
gccaagcatttaggtgacactataggtatgttgctctggttgatagtttcagagctatgctggaaacagc

SEQ ID NO: 64403 - DNA, 70 bp, Artificial Sequence
  Synthetic
gccaagcatttaggtgacactataggattgcccaccttgagtgaggtttcagagctatgctggaaacagc

SEQ ID NO: 64404 - DNA, 70 bp, Artificial Sequence
  Synthetic
gccaagcatttaggtgacactatagctcagcatatcattcatctcgtttcagagctatgctggaaacagc

SEQ ID NO: 64405 - DNA, 70 bp, Artificial Sequence
  Synthetic
gccaagcatttaggtgacactataggtatgcaggagaaatcgaatgtttcagagctatgctggaaacagc

SEQ ID NO: 64406 - DNA, 70 bp, Artificial Sequence
  Synthetic
gccaagcatttaggtgacactataggacatacttaggactgagtagtttcagagctatgctggaaacagc

SEQ ID NO: 64407 - DNA, 70 bp, Artificial Sequence
  Synthetic
gccaagcatttaggtgacactatagggaccttgaacatttaatgcgtttcagagctatgctggaaacagc

SEQ ID NO: 64408 - DNA, 70 bp, Artificial Sequence
  Synthetic
gccaagcatttaggtgacactatagcatactgtatacctcgtgttgtttcagagctatgctggaaacagc

SEQ ID NO: 64409 - DNA, 70 bp, Artificial Sequence
  Synthetic
gccaagcatttaggtgacactatagaggctgaagtcaggccgcgtgtttcagagctatgctggaaacagc

SEQ ID NO: 64410 - DNA, 70 bp, Artificial Sequence
  Synthetic
gccaagcatttaggtgacactatagtgatgcaaaagaagttaggagtttcagagctatgctggaaacagc

SEQ ID NO: 64411 - DNA, 70 bp, Artificial Sequence
  Synthetic
gccaagcatttaggtgacactatagacggatgtcggggactagctgtttcagagctatgctggaaacagc

SEQ ID NO: 64412 - DNA, 70 bp, Artificial Sequence
  Synthetic
gccaagcatttaggtgacactatagggagatcgagatggagatgtgtttcagagctatgctggaaacagc

SEQ ID NO: 64413 - DNA, 70 bp, Artificial Sequence
  Synthetic
gccaagcatttaggtgacactataggcatctggacctccctaactgtttcagagctatgctggaaacagc

SEQ ID NO: 64414 - DNA, 70 bp, Artificial Sequence
  Synthetic
gccaagcatttaggtgacactatagtaaatgttgagtgcagatgagtttcagagctatgctggaaacagc

SEQ ID NO: 64415 - DNA, 70 bp, Artificial Sequence
  Synthetic
gccaagcatttaggtgacactatagcttggtctgagaagtctatggtttcagagctatgctggaaacagc

SEQ ID NO: 64416 - DNA, 70 bp, Artificial Sequence
  Synthetic
gccaagcatttaggtgacactatagaccaggaggccttcgtgtaggtttcagagctatgctggaaacagc

SEQ ID NO: 64417 - DNA, 70 bp, Artificial Sequence
  Synthetic
gccaagcatttaggtgacactatagtctgaactatgcaattgcaggtttcagagctatgctggaaacagc

SEQ ID NO: 64418 - DNA, 70 bp, Artificial Sequence
  Synthetic
gccaagcatttaggtgacactatagatgaaagaagctggtaaggggtttcagagctatgctggaaacagc

SEQ ID NO: 64419 - DNA, 70 bp, Artificial Sequence
  Synthetic
gccaagcatttaggtgacactatagttccagagagctaaagccgagtttcagagctatgctggaaacagc

SEQ ID NO: 64420 - DNA, 70 bp, Artificial Sequence
  Synthetic
gccaagcatttaggtgacactatagagaaggcagcggagtcctgagtttcagagctatgctggaaacagc

SEQ ID NO: 64421 - DNA, 70 bp, Artificial Sequence
  Synthetic
gccaagcatttaggtgacactatagaatgggtatctatctcacaagtttcagagctatgctggaaacagc

SEQ ID NO: 64422 - DNA, 70 bp, Artificial Sequence
  Synthetic
gccaagcatttaggtgacactatagcgcccccggacaacaagaaggtttcagagctatgctggaaacagc

SEQ ID NO: 64423 - DNA, 70 bp, Artificial Sequence
  Synthetic
gccaagcatttaggtgacactatagaggaggaaaatccacaaactgtttcagagctatgctggaaacagc

SEQ ID NO: 64424 - DNA, 70 bp, Artificial Sequence
  Synthetic
gccaagcatttaggtgacactatagttttctactctttctgcttcgtttcagagctatgctggaaacagc

SEQ ID NO: 64425 - DNA, 70 bp, Artificial Sequence
  Synthetic
gccaagcatttaggtgacactatagcgcgatgtcagacgttcagcgtttcagagctatgctggaaacagc

SEQ ID NO: 64426 - DNA, 70 bp, Artificial Sequence
  Synthetic
gccaagcatttaggtgacactatagccaccgcgaggaagaaaagggtttcagagctatgctggaaacagc

SEQ ID NO: 64427 - DNA, 70 bp, Artificial Sequence
  Synthetic
gccaagcatttaggtgacactatagcgctctctttgttagatatggtttcagagctatgctggaaacagc

SEQ ID NO: 64428 - DNA, 70 bp, Artificial Sequence
  Synthetic
gccaagcatttaggtgacactatagtgtggagttgtgtgcactatgtttcagagctatgctggaaacagc

SEQ ID NO: 64429 - DNA, 70 bp, Artificial Sequence
  Synthetic
gccaagcatttaggtgacactatagagttttctacgctgagtattgtttcagagctatgctggaaacagc

SEQ ID NO: 64430 - DNA, 70 bp, Artificial Sequence
  Synthetic
gccaagcatttaggtgacactatagcgggagtgcggctcagaccagtttcagagctatgctggaaacagc

SEQ ID NO: 64431 - DNA, 70 bp, Artificial Sequence
  Synthetic
gccaagcatttaggtgacactatagcaaatcactgtcttctgcccgtttcagagctatgctggaaacagc

SEQ ID NO: 64432 - DNA, 70 bp, Artificial Sequence
  Synthetic
gccaagcatttaggtgacactatagcttctaagagaaccacattggtttcagagctatgctggaaacagc

SEQ ID NO: 64433 - DNA, 70 bp, Artificial Sequence
  Synthetic
gccaagcatttaggtgacactatagttctggtccaggcagatcaggtttcagagctatgctggaaacagc

SEQ ID NO: 64434 - DNA, 70 bp, Artificial Sequence
  Synthetic
gccaagcatttaggtgacactatagttctctatgatgtctccatagtttcagagctatgctggaaacagc

SEQ ID NO: 64435 - DNA, 70 bp, Artificial Sequence
  Synthetic
gccaagcatttaggtgacactatagactatcaatagcagcttaacgtttcagagctatgctggaaacagc

SEQ ID NO: 64436 - DNA, 70 bp, Artificial Sequence
  Synthetic
gccaagcatttaggtgacactatagccagtgaagatgcttcagacgtttcagagctatgctggaaacagc

SEQ ID NO: 64437 - DNA, 70 bp, Artificial Sequence
  Synthetic
gccaagcatttaggtgacactatagtatgtcagaattcagtgacggtttcagagctatgctggaaacagc

SEQ ID NO: 64438 - DNA, 70 bp, Artificial Sequence
  Synthetic
gccaagcatttaggtgacactatagcaagcttctttgctagtgccgtttcagagctatgctggaaacagc

SEQ ID NO: 64439 - DNA, 70 bp, Artificial Sequence
  Synthetic
gccaagcatttaggtgacactatagagtcaagaggtcaaggtgtagtttcagagctatgctggaaacagc

SEQ ID NO: 64440 - DNA, 70 bp, Artificial Sequence
  Synthetic
gccaagcatttaggtgacactatagagtggccatgcctgtgtgaggtttcagagctatgctggaaacagc

SEQ ID NO: 64441 - DNA, 70 bp, Artificial Sequence
  Synthetic
gccaagcatttaggtgacactatagagcttctagagtgattaggagtttcagagctatgctggaaacagc

SEQ ID NO: 64442 - DNA, 70 bp, Artificial Sequence
  Synthetic
gccaagcatttaggtgacactatagtgccgataactcaaaagatagtttcagagctatgctggaaacagc

SEQ ID NO: 64443 - DNA, 70 bp, Artificial Sequence
  Synthetic
gccaagcatttaggtgacactatagcgctgagcacaggccttgacgtttcagagctatgctggaaacagc

SEQ ID NO: 64444 - DNA, 70 bp, Artificial Sequence
  Synthetic
gccaagcatttaggtgacactatagacccatcttaatgacaagtagtttcagagctatgctggaaacagc

SEQ ID NO: 64445 - DNA, 70 bp, Artificial Sequence
  Synthetic
gccaagcatttaggtgacactatagtccctcggtggcggctacacgtttcagagctatgctggaaacagc

SEQ ID NO: 64446 - DNA, 70 bp, Artificial Sequence
  Synthetic
gccaagcatttaggtgacactatagactgtcttcaagggtcacacgtttcagagctatgctggaaacagc

SEQ ID NO: 64447 - DNA, 70 bp, Artificial Sequence
  Synthetic
gccaagcatttaggtgacactatagagcatgatgtgtggcgttcagtttcagagctatgctggaaacagc

SEQ ID NO: 64448 - DNA, 70 bp, Artificial Sequence
  Synthetic
gccaagcatttaggtgacactataggattatttctggaggagcaagtttcagagctatgctggaaacagc

SEQ ID NO: 64449 - DNA, 70 bp, Artificial Sequence
  Synthetic
gccaagcatttaggtgacactatagtcagagtgagtaactccaacgtttcagagctatgctggaaacagc

SEQ ID NO: 64450 - DNA, 70 bp, Artificial Sequence
  Synthetic
gccaagcatttaggtgacactatagtgaaccaagaaagaaatacggtttcagagctatgctggaaacagc

SEQ ID NO: 64451 - DNA, 70 bp, Artificial Sequence
  Synthetic
gccaagcatttaggtgacactatagggagggacttctaagtgaaggtttcagagctatgctggaaacagc

SEQ ID NO: 64452 - DNA, 70 bp, Artificial Sequence
  Synthetic
gccaagcatttaggtgacactatagtgcttgtaatcccagcatttgtttcagagctatgctggaaacagc

SEQ ID NO: 64453 - DNA, 70 bp, Artificial Sequence
  Synthetic
gccaagcatttaggtgacactatagaaagctctcagtatgaattcgtttcagagctatgctggaaacagc

SEQ ID NO: 64454 - DNA, 70 bp, Artificial Sequence
  Synthetic
gccaagcatttaggtgacactatagatgttgatttctggagccttgtttcagagctatgctggaaacagc

SEQ ID NO: 64455 - DNA, 70 bp, Artificial Sequence
  Synthetic
gccaagcatttaggtgacactatagctctgagtcgaaacccataggtttcagagctatgctggaaacagc

SEQ ID NO: 64456 - DNA, 70 bp, Artificial Sequence
  Synthetic
gccaagcatttaggtgacactatagtactggctcctgcaaacctggtttcagagctatgctggaaacagc

SEQ ID NO: 64457 - DNA, 70 bp, Artificial Sequence
  Synthetic
gccaagcatttaggtgacactatagttgaacctcaaagcctaagggtttcagagctatgctggaaacagc

SEQ ID NO: 64458 - DNA, 70 bp, Artificial Sequence
  Synthetic
gccaagcatttaggtgacactatagccagaaactgagagctagtggtttcagagctatgctggaaacagc

SEQ ID NO: 64459 - DNA, 70 bp, Artificial Sequence
  Synthetic
gccaagcatttaggtgacactatagccccacctgcccaggctcaggtttcagagctatgctggaaacagc

SEQ ID NO: 64460 - DNA, 70 bp, Artificial Sequence
  Synthetic
gccaagcatttaggtgacactatagtgcccaggctcaggagtcacgtttcagagctatgctggaaacagc

SEQ ID NO: 64461 - DNA, 70 bp, Artificial Sequence
  Synthetic
gccaagcatttaggtgacactatagctgcactgtccagcctaggcgtttcagagctatgctggaaacagc

SEQ ID NO: 64462 - DNA, 70 bp, Artificial Sequence
  Synthetic
gccaagcatttaggtgacactatagggactcaggcaaaatatgcagtttcagagctatgctggaaacagc

SEQ ID NO: 64463 - DNA, 70 bp, Artificial Sequence
  Synthetic
gccaagcatttaggtgacactatagatggcagtgtcaggcgaagtgtttcagagctatgctggaaacagc

SEQ ID NO: 64464 - DNA, 70 bp, Artificial Sequence
  Synthetic
gccaagcatttaggtgacactatagtggggctattttgcttagtggtttcagagctatgctggaaacagc

SEQ ID NO: 64465 - DNA, 70 bp, Artificial Sequence
  Synthetic
gccaagcatttaggtgacactatagtttgagactacccatttctagtttcagagctatgctggaaacagc

SEQ ID NO: 64466 - DNA, 70 bp, Artificial Sequence
  Synthetic
gccaagcatttaggtgacactatagcttaggcatagaagccccaggtttcagagctatgctggaaacagc

SEQ ID NO: 64467 - DNA, 70 bp, Artificial Sequence
  Synthetic
gccaagcatttaggtgacactatagctttttgctgtgtgttcactgtttcagagctatgctggaaacagc

SEQ ID NO: 64468 - DNA, 70 bp, Artificial Sequence
  Synthetic
gccaagcatttaggtgacactataggctgtggtggtctttattcagtttcagagctatgctggaaacagc

SEQ ID NO: 64469 - DNA, 70 bp, Artificial Sequence
  Synthetic
gccaagcatttaggtgacactataggcggctggccctgtcctcaggtttcagagctatgctggaaacagc

SEQ ID NO: 64470 - DNA, 70 bp, Artificial Sequence
  Synthetic
gccaagcatttaggtgacactataggggtcctgagtcaacatcacgtttcagagctatgctggaaacagc

SEQ ID NO: 64471 - DNA, 70 bp, Artificial Sequence
  Synthetic
gccaagcatttaggtgacactatagattccagtccagaagggtctgtttcagagctatgctggaaacagc

SEQ ID NO: 64472 - DNA, 70 bp, Artificial Sequence
  Synthetic
gccaagcatttaggtgacactatagatcagagtggcaagagcaatgtttcagagctatgctggaaacagc

SEQ ID NO: 64473 - DNA, 70 bp, Artificial Sequence
  Synthetic
gccaagcatttaggtgacactatagatcacgcaaaatagccccaggtttcagagctatgctggaaacagc

SEQ ID NO: 64474 - DNA, 70 bp, Artificial Sequence
  Synthetic
gccaagcatttaggtgacactatagaaggaggcctacatctaggggtttcagagctatgctggaaacagc

SEQ ID NO: 64475 - DNA, 70 bp, Artificial Sequence
  Synthetic
gccaagcatttaggtgacactatagcatggagttttgggagtaaggtttcagagctatgctggaaacagc

SEQ ID NO: 64476 - DNA, 70 bp, Artificial Sequence
  Synthetic
gccaagcatttaggtgacactataggaaggagacgcacttctgaggtttcagagctatgctggaaacagc

SEQ ID NO: 64477 - DNA, 70 bp, Artificial Sequence
  Synthetic
gccaagcatttaggtgacactataggagaaggagacccatttgtagtttcagagctatgctggaaacagc

SEQ ID NO: 64478 - DNA, 70 bp, Artificial Sequence
  Synthetic
gccaagcatttaggtgacactataggctagagtctcactgctagggtttcagagctatgctggaaacagc

SEQ ID NO: 64479 - DNA, 70 bp, Artificial Sequence
  Synthetic
gccaagcatttaggtgacactatagacatctatgggactccccaggtttcagagctatgctggaaacagc

SEQ ID NO: 64480 - DNA, 70 bp, Artificial Sequence
  Synthetic
gccaagcatttaggtgacactatagtgttagtggcagcagaaaacgtttcagagctatgctggaaacagc

SEQ ID NO: 64481 - DNA, 70 bp, Artificial Sequence
  Synthetic
gccaagcatttaggtgacactatagccagaatctgatttgtagctgtttcagagctatgctggaaacagc

SEQ ID NO: 64482 - DNA, 70 bp, Artificial Sequence
  Synthetic
gccaagcatttaggtgacactatagtctgtaacagaatttgagaggtttcagagctatgctggaaacagc

SEQ ID NO: 64483 - DNA, 70 bp, Artificial Sequence
  Synthetic
gccaagcatttaggtgacactatagacccagtaaagaggttcaaagtttcagagctatgctggaaacagc

SEQ ID NO: 64484 - DNA, 70 bp, Artificial Sequence
  Synthetic
gccaagcatttaggtgacactatagagtggtcacagctccgactcgtttcagagctatgctggaaacagc

SEQ ID NO: 64485 - DNA, 70 bp, Artificial Sequence
  Synthetic
gccaagcatttaggtgacactatagcttcagcgcatgtccgtgtcgtttcagagctatgctggaaacagc

SEQ ID NO: 64486 - DNA, 70 bp, Artificial Sequence
  Synthetic
gccaagcatttaggtgacactatagggggacctgaagtactgagagtttcagagctatgctggaaacagc

SEQ ID NO: 64487 - DNA, 70 bp, Artificial Sequence
  Synthetic
gccaagcatttaggtgacactatagctcctccaggcaggctcagagtttcagagctatgctggaaacagc

SEQ ID NO: 64488 - DNA, 70 bp, Artificial Sequence
  Synthetic
gccaagcatttaggtgacactatagttcagggatttctgttcagcgtttcagagctatgctggaaacagc

SEQ ID NO: 64489 - DNA, 70 bp, Artificial Sequence
  Synthetic
gccaagcatttaggtgacactataggaagcccacatctcaggccagtttcagagctatgctggaaacagc

SEQ ID NO: 64490 - DNA, 70 bp, Artificial Sequence
  Synthetic
gccaagcatttaggtgacactatagccactggctcaaggtgtagagtttcagagctatgctggaaacagc

SEQ ID NO: 64491 - DNA, 70 bp, Artificial Sequence
  Synthetic
gccaagcatttaggtgacactatagtgtgttacacagcattcaaggtttcagagctatgctggaaacagc

SEQ ID NO: 64492 - DNA, 70 bp, Artificial Sequence
  Synthetic
gccaagcatttaggtgacactatagccagtgaaggatttggaactgtttcagagctatgctggaaacagc

SEQ ID NO: 64493 - DNA, 70 bp, Artificial Sequence
  Synthetic
gccaagcatttaggtgacactatagacccgagagagctcacatcagtttcagagctatgctggaaacagc

SEQ ID NO: 64494 - DNA, 70 bp, Artificial Sequence
  Synthetic
gccaagcatttaggtgacactataggtcatcgagttctgggagtagtttcagagctatgctggaaacagc

SEQ ID NO: 64495 - DNA, 70 bp, Artificial Sequence
  Synthetic
gccaagcatttaggtgacactataggaggaggagtcgatgatgtggtttcagagctatgctggaaacagc

SEQ ID NO: 64496 - DNA, 70 bp, Artificial Sequence
  Synthetic
gccaagcatttaggtgacactataggagcagcaaggtcgtcgtgggtttcagagctatgctggaaacagc

SEQ ID NO: 64497 - DNA, 70 bp, Artificial Sequence
  Synthetic
gccaagcatttaggtgacactatagctggcagctgtgctcatatcgtttcagagctatgctggaaacagc

SEQ ID NO: 64498 - DNA, 70 bp, Artificial Sequence
  Synthetic
gccaagcatttaggtgacactataggggctgtgcgtcacttgcacgtttcagagctatgctggaaacagc

SEQ ID NO: 64499 - DNA, 70 bp, Artificial Sequence
  Synthetic
gccaagcatttaggtgacactatagaaaatctcattgtggcttcggtttcagagctatgctggaaacagc

SEQ ID NO: 64500 - DNA, 70 bp, Artificial Sequence
  Synthetic
gccaagcatttaggtgacactatagtatgggacaagaaacccagggtttcagagctatgctggaaacagc

SEQ ID NO: 64501 - DNA, 70 bp, Artificial Sequence
  Synthetic
gccaagcatttaggtgacactatagttgcctccctgatgtgtctggtttcagagctatgctggaaacagc

SEQ ID NO: 64502 - DNA, 70 bp, Artificial Sequence
  Synthetic
gccaagcatttaggtgacactatagcttgtgtgtttctcctactcgtttcagagctatgctggaaacagc

SEQ ID NO: 64503 - DNA, 70 bp, Artificial Sequence
  Synthetic
gccaagcatttaggtgacactatagaaaggtgaactgagatttctgtttcagagctatgctggaaacagc

SEQ ID NO: 64504 - DNA, 70 bp, Artificial Sequence
  Synthetic
gccaagcatttaggtgacactatagtgtgacgatgtcaaactgaggtttcagagctatgctggaaacagc

SEQ ID NO: 64505 - DNA, 70 bp, Artificial Sequence
  Synthetic
gccaagcatttaggtgacactatagggctgatcagctactccatagtttcagagctatgctggaaacagc

SEQ ID NO: 64506 - DNA, 70 bp, Artificial Sequence
  Synthetic
gccaagcatttaggtgacactataggtcccccaggagacatagccgtttcagagctatgctggaaacagc

SEQ ID NO: 64507 - DNA, 70 bp, Artificial Sequence
  Synthetic
gccaagcatttaggtgacactatagatgagaggaaaactgactaggtttcagagctatgctggaaacagc

SEQ ID NO: 64508 - DNA, 70 bp, Artificial Sequence
  Synthetic
gccaagcatttaggtgacactatagacgacctggattcagactgagtttcagagctatgctggaaacagc

SEQ ID NO: 64509 - DNA, 70 bp, Artificial Sequence
  Synthetic
gccaagcatttaggtgacactatagaggagagatgcccaagcaacgtttcagagctatgctggaaacagc

SEQ ID NO: 64510 - DNA, 70 bp, Artificial Sequence
  Synthetic
gccaagcatttaggtgacactataggcggggcagccccagccctggtttcagagctatgctggaaacagc

SEQ ID NO: 64511 - DNA, 70 bp, Artificial Sequence
  Synthetic
gccaagcatttaggtgacactatagagagacggagcttgttactcgtttcagagctatgctggaaacagc

SEQ ID NO: 64512 - DNA, 70 bp, Artificial Sequence
  Synthetic
gccaagcatttaggtgacactataggccacataaaaggcttctaagtttcagagctatgctggaaacagc

SEQ ID NO: 64513 - DNA, 70 bp, Artificial Sequence
  Synthetic
gccaagcatttaggtgacactatagtgccacatccggggcttctagtttcagagctatgctggaaacagc

SEQ ID NO: 64514 - DNA, 70 bp, Artificial Sequence
  Synthetic
gccaagcatttaggtgacactatagaggcctattgctacatcaaggtttcagagctatgctggaaacagc

SEQ ID NO: 64515 - DNA, 70 bp, Artificial Sequence
  Synthetic
gccaagcatttaggtgacactataggcttcagtcacatgcttttcgtttcagagctatgctggaaacagc

SEQ ID NO: 64516 - DNA, 70 bp, Artificial Sequence
  Synthetic
gccaagcatttaggtgacactataggccctggtgttactgcccctgtttcagagctatgctggaaacagc

SEQ ID NO: 64517 - DNA, 70 bp, Artificial Sequence
  Synthetic
gccaagcatttaggtgacactatagaaggcttctcactcccaaatgtttcagagctatgctggaaacagc

SEQ ID NO: 64518 - DNA, 70 bp, Artificial Sequence
  Synthetic
gccaagcatttaggtgacactatagacatgtgtgtggactcgggggtttcagagctatgctggaaacagc

SEQ ID NO: 64519 - DNA, 70 bp, Artificial Sequence
  Synthetic
gccaagcatttaggtgacactatagggtggcagcagggcgctcaggtttcagagctatgctggaaacagc

SEQ ID NO: 64520 - DNA, 70 bp, Artificial Sequence
  Synthetic
gccaagcatttaggtgacactatagcgccacagatggactggaacgtttcagagctatgctggaaacagc

SEQ ID NO: 64521 - DNA, 70 bp, Artificial Sequence
  Synthetic
gccaagcatttaggtgacactatagttttttggagcaaaggactagtttcagagctatgctggaaacagc

SEQ ID NO: 64522 - DNA, 70 bp, Artificial Sequence
  Synthetic
gccaagcatttaggtgacactatagccgaggccttgagctacagcgtttcagagctatgctggaaacagc

SEQ ID NO: 64523 - DNA, 70 bp, Artificial Sequence
  Synthetic
gccaagcatttaggtgacactataggaggggacgctaggctctccgtttcagagctatgctggaaacagc

SEQ ID NO: 64524 - DNA, 70 bp, Artificial Sequence
  Synthetic
gccaagcatttaggtgacactataggagtattagtaagcttaggcgtttcagagctatgctggaaacagc

SEQ ID NO: 64525 - DNA, 70 bp, Artificial Sequence
  Synthetic
gccaagcatttaggtgacactatagaaagtcaagcattatcttccgtttcagagctatgctggaaacagc

SEQ ID NO: 64526 - DNA, 70 bp, Artificial Sequence
  Synthetic
gccaagcatttaggtgacactatagcggctccgaggacgacgagcgtttcagagctatgctggaaacagc

SEQ ID NO: 64527 - DNA, 70 bp, Artificial Sequence
  Synthetic
gccaagcatttaggtgacactatagctcaagcttgagcaaactttgtttcagagctatgctggaaacagc

SEQ ID NO: 64528 - DNA, 70 bp, Artificial Sequence
  Synthetic
gccaagcatttaggtgacactatagcttcggttattgcctttcctgtttcagagctatgctggaaacagc

SEQ ID NO: 64529 - DNA, 70 bp, Artificial Sequence
  Synthetic
gccaagcatttaggtgacactatagtaatggcgtgtaagcattttgtttcagagctatgctggaaacagc

SEQ ID NO: 64530 - DNA, 70 bp, Artificial Sequence
  Synthetic
gccaagcatttaggtgacactatagagacttctgtgcaagtttaggtttcagagctatgctggaaacagc

SEQ ID NO: 64531 - DNA, 70 bp, Artificial Sequence
  Synthetic
gccaagcatttaggtgacactatagttcaactttctgcagaagccgtttcagagctatgctggaaacagc

SEQ ID NO: 64532 - DNA, 70 bp, Artificial Sequence
  Synthetic
gccaagcatttaggtgacactatagagtcccctagaataaacctagtttcagagctatgctggaaacagc

SEQ ID NO: 64533 - DNA, 70 bp, Artificial Sequence
  Synthetic
gccaagcatttaggtgacactatagaacacggtctttgaacaaccgtttcagagctatgctggaaacagc

SEQ ID NO: 64534 - DNA, 70 bp, Artificial Sequence
  Synthetic
gccaagcatttaggtgacactatagttcatcatctttcaaaaccggtttcagagctatgctggaaacagc

SEQ ID NO: 64535 - DNA, 70 bp, Artificial Sequence
  Synthetic
gccaagcatttaggtgacactatagacattttgtcccttctgctggtttcagagctatgctggaaacagc

SEQ ID NO: 64536 - DNA, 70 bp, Artificial Sequence
  Synthetic
gccaagcatttaggtgacactatagttactatctgttccagcagagtttcagagctatgctggaaacagc

SEQ ID NO: 64537 - DNA, 70 bp, Artificial Sequence
  Synthetic
gccaagcatttaggtgacactatagatactttggtatcctttccagtttcagagctatgctggaaacagc

SEQ ID NO: 64538 - DNA, 70 bp, Artificial Sequence
  Synthetic
gccaagcatttaggtgacactatagggtgtctacaagattccaaagtttcagagctatgctggaaacagc

SEQ ID NO: 64539 - DNA, 70 bp, Artificial Sequence
  Synthetic
gccaagcatttaggtgacactatagtaaagttgagtttccttgccgtttcagagctatgctggaaacagc

SEQ ID NO: 64540 - DNA, 70 bp, Artificial Sequence
  Synthetic
gccaagcatttaggtgacactataggcccagggtggggtcagatggtttcagagctatgctggaaacagc

SEQ ID NO: 64541 - DNA, 70 bp, Artificial Sequence
  Synthetic
gccaagcatttaggtgacactataggccccaagacagctcacactgtttcagagctatgctggaaacagc

SEQ ID NO: 64542 - DNA, 70 bp, Artificial Sequence
  Synthetic
gccaagcatttaggtgacactatagactcctttgtgagaagctgagtttcagagctatgctggaaacagc

SEQ ID NO: 64543 - DNA, 70 bp, Artificial Sequence
  Synthetic
gccaagcatttaggtgacactatagccatgagtggtgtgaaaacagtttcagagctatgctggaaacagc

SEQ ID NO: 64544 - DNA, 70 bp, Artificial Sequence
  Synthetic
gccaagcatttaggtgacactataggcggtggtcagacgctgctcgtttcagagctatgctggaaacagc

SEQ ID NO: 64545 - DNA, 70 bp, Artificial Sequence
  Synthetic
gccaagcatttaggtgacactatagaatgacacatctgtggctgagtttcagagctatgctggaaacagc

SEQ ID NO: 64546 - DNA, 70 bp, Artificial Sequence
  Synthetic
gccaagcatttaggtgacactatagattcctactccaatctacttgtttcagagctatgctggaaacagc

SEQ ID NO: 64547 - DNA, 70 bp, Artificial Sequence
  Synthetic
gccaagcatttaggtgacactatagttccattttcaagcttcagggtttcagagctatgctggaaacagc

SEQ ID NO: 64548 - DNA, 70 bp, Artificial Sequence
  Synthetic
gccaagcatttaggtgacactatagagaagaaactgacttgtaacgtttcagagctatgctggaaacagc

SEQ ID NO: 64549 - DNA, 70 bp, Artificial Sequence
  Synthetic
gccaagcatttaggtgacactatagaatgatgtgtcggtcagtcagtttcagagctatgctggaaacagc

SEQ ID NO: 64550 - DNA, 70 bp, Artificial Sequence
  Synthetic
gccaagcatttaggtgacactatagcgcgggggcaagggtatgaggtttcagagctatgctggaaacagc

SEQ ID NO: 64551 - DNA, 70 bp, Artificial Sequence
  Synthetic
gccaagcatttaggtgacactatagctgggtaccagattcttaatgtttcagagctatgctggaaacagc

SEQ ID NO: 64552 - DNA, 70 bp, Artificial Sequence
  Synthetic
gccaagcatttaggtgacactatagtaacaaaatgacacctgagtgtttcagagctatgctggaaacagc

SEQ ID NO: 64553 - DNA, 70 bp, Artificial Sequence
  Synthetic
gccaagcatttaggtgacactatagtgatttggagttcttcctaagtttcagagctatgctggaaacagc

SEQ ID NO: 64554 - DNA, 70 bp, Artificial Sequence
  Synthetic
gccaagcatttaggtgacactatagcttgtcgaaggctcacctgagtttcagagctatgctggaaacagc

SEQ ID NO: 64555 - DNA, 70 bp, Artificial Sequence
  Synthetic
gccaagcatttaggtgacactatagagctcaaacaatgaaagactgtttcagagctatgctggaaacagc

SEQ ID NO: 64556 - DNA, 70 bp, Artificial Sequence
  Synthetic
gccaagcatttaggtgacactatagatataggtgctgttttgcccgtttcagagctatgctggaaacagc

SEQ ID NO: 64557 - DNA, 70 bp, Artificial Sequence
  Synthetic
gccaagcatttaggtgacactatagtctacctgctttatgaaaaggtttcagagctatgctggaaacagc

SEQ ID NO: 64558 - DNA, 70 bp, Artificial Sequence
  Synthetic
gccaagcatttaggtgacactatagacatctgccagccagtgaccgtttcagagctatgctggaaacagc

SEQ ID NO: 64559 - DNA, 70 bp, Artificial Sequence
  Synthetic
gccaagcatttaggtgacactatagtctgaaggcttctgtgtgacgtttcagagctatgctggaaacagc

SEQ ID NO: 64560 - DNA, 70 bp, Artificial Sequence
  Synthetic
gccaagcatttaggtgacactatagctgctccccagggccctcacgtttcagagctatgctggaaacagc

SEQ ID NO: 64561 - DNA, 70 bp, Artificial Sequence
  Synthetic
gccaagcatttaggtgacactatagacttcggaatgcactacaacgtttcagagctatgctggaaacagc

SEQ ID NO: 64562 - DNA, 70 bp, Artificial Sequence
  Synthetic
gccaagcatttaggtgacactatagtcagatgtttgcggaagtttgtttcagagctatgctggaaacagc

SEQ ID NO: 64563 - DNA, 70 bp, Artificial Sequence
  Synthetic
gccaagcatttaggtgacactatagacgcccagcgctatgcgcaggtttcagagctatgctggaaacagc

SEQ ID NO: 64564 - DNA, 70 bp, Artificial Sequence
  Synthetic
gccaagcatttaggtgacactatagtggtgaagtgcggctgtacggtttcagagctatgctggaaacagc

SEQ ID NO: 64565 - DNA, 70 bp, Artificial Sequence
  Synthetic
gccaagcatttaggtgacactatagcaggggcttaggaacacgcggtttcagagctatgctggaaacagc

SEQ ID NO: 64566 - DNA, 70 bp, Artificial Sequence
  Synthetic
gccaagcatttaggtgacactataggcccacagagtgtatgactggtttcagagctatgctggaaacagc

SEQ ID NO: 64567 - DNA, 70 bp, Artificial Sequence
  Synthetic
gccaagcatttaggtgacactatagtgcaatcagtcagctgtgaagtttcagagctatgctggaaacagc

SEQ ID NO: 64568 - DNA, 70 bp, Artificial Sequence
  Synthetic
gccaagcatttaggtgacactatagtcctggagaagacaacatacgtttcagagctatgctggaaacagc

SEQ ID NO: 64569 - DNA, 70 bp, Artificial Sequence
  Synthetic
gccaagcatttaggtgacactatagaacagctttgaacaagatctgtttcagagctatgctggaaacagc

SEQ ID NO: 64570 - DNA, 70 bp, Artificial Sequence
  Synthetic
gccaagcatttaggtgacactatagcttttagaactggctaaacggtttcagagctatgctggaaacagc

SEQ ID NO: 64571 - DNA, 70 bp, Artificial Sequence
  Synthetic
gccaagcatttaggtgacactatagcctggagcagcaaacatagagtttcagagctatgctggaaacagc

SEQ ID NO: 64572 - DNA, 70 bp, Artificial Sequence
  Synthetic
gccaagcatttaggtgacactatagtgcttccctttgttatgatcgtttcagagctatgctggaaacagc

SEQ ID NO: 64573 - DNA, 70 bp, Artificial Sequence
  Synthetic
gccaagcatttaggtgacactatagacgctctcatggagaagctcgtttcagagctatgctggaaacagc

SEQ ID NO: 64574 - DNA, 70 bp, Artificial Sequence
  Synthetic
gccaagcatttaggtgacactatagatggatatccgatttgctttgtttcagagctatgctggaaacagc

SEQ ID NO: 64575 - DNA, 70 bp, Artificial Sequence
  Synthetic
gccaagcatttaggtgacactatagtttggtgtttcggtccattggtttcagagctatgctggaaacagc

SEQ ID NO: 64576 - DNA, 70 bp, Artificial Sequence
  Synthetic
gccaagcatttaggtgacactatagggaataaatctaccgttcccgtttcagagctatgctggaaacagc

SEQ ID NO: 64577 - DNA, 70 bp, Artificial Sequence
  Synthetic
gccaagcatttaggtgacactatagagtgttgcatgggcatgtgtgtttcagagctatgctggaaacagc

SEQ ID NO: 64578 - DNA, 70 bp, Artificial Sequence
  Synthetic
gccaagcatttaggtgacactataggctcattttcagaatcgtcggtttcagagctatgctggaaacagc

SEQ ID NO: 64579 - DNA, 70 bp, Artificial Sequence
  Synthetic
gccaagcatttaggtgacactatagtgactagttgctactgtccagtttcagagctatgctggaaacagc

SEQ ID NO: 64580 - DNA, 70 bp, Artificial Sequence
  Synthetic
gccaagcatttaggtgacactatagcttccgagacctctgcaactgtttcagagctatgctggaaacagc

SEQ ID NO: 64581 - DNA, 70 bp, Artificial Sequence
  Synthetic
gccaagcatttaggtgacactatagctgaggatcaggtctccagcgtttcagagctatgctggaaacagc

SEQ ID NO: 64582 - DNA, 70 bp, Artificial Sequence
  Synthetic
gccaagcatttaggtgacactatagaaggtggagcggaactgatggtttcagagctatgctggaaacagc

SEQ ID NO: 64583 - DNA, 70 bp, Artificial Sequence
  Synthetic
gccaagcatttaggtgacactatagacaaacctcttcggtgttaagtttcagagctatgctggaaacagc

SEQ ID NO: 64584 - DNA, 70 bp, Artificial Sequence
  Synthetic
gccaagcatttaggtgacactatagtaagaactttatccagccacgtttcagagctatgctggaaacagc

SEQ ID NO: 64585 - DNA, 70 bp, Artificial Sequence
  Synthetic
gccaagcatttaggtgacactatagatgcttgagcaacgcactgagtttcagagctatgctggaaacagc

SEQ ID NO: 64586 - DNA, 70 bp, Artificial Sequence
  Synthetic
gccaagcatttaggtgacactatagttgatgtctctaagacacacgtttcagagctatgctggaaacagc

SEQ ID NO: 64587 - DNA, 70 bp, Artificial Sequence
  Synthetic
gccaagcatttaggtgacactataggacccacaacctttagactggtttcagagctatgctggaaacagc

SEQ ID NO: 64588 - DNA, 70 bp, Artificial Sequence
  Synthetic
gccaagcatttaggtgacactatagacagaagatatggggttcaggtttcagagctatgctggaaacagc

SEQ ID NO: 64589 - DNA, 70 bp, Artificial Sequence
  Synthetic
gccaagcatttaggtgacactatagccgccggggccgccactatcgtttcagagctatgctggaaacagc

SEQ ID NO: 64590 - DNA, 70 bp, Artificial Sequence
  Synthetic
gccaagcatttaggtgacactatagtcccctccgcacgcggctacgtttcagagctatgctggaaacagc

SEQ ID NO: 64591 - DNA, 70 bp, Artificial Sequence
  Synthetic
gccaagcatttaggtgacactataggggaaaaacctgatgtcaccgtttcagagctatgctggaaacagc

SEQ ID NO: 64592 - DNA, 70 bp, Artificial Sequence
  Synthetic
gccaagcatttaggtgacactatagactgaagaaatggggttatggtttcagagctatgctggaaacagc

SEQ ID NO: 64593 - DNA, 70 bp, Artificial Sequence
  Synthetic
gccaagcatttaggtgacactatagggccaagggcagcgagaaaggtttcagagctatgctggaaacagc

SEQ ID NO: 64594 - DNA, 70 bp, Artificial Sequence
  Synthetic
gccaagcatttaggtgacactatagagactctcagcacacaactggtttcagagctatgctggaaacagc

SEQ ID NO: 64595 - DNA, 70 bp, Artificial Sequence
  Synthetic
gccaagcatttaggtgacactatagtctactggccaatgacaagggtttcagagctatgctggaaacagc

SEQ ID NO: 64596 - DNA, 70 bp, Artificial Sequence
  Synthetic
gccaagcatttaggtgacactatagagactctcagtcctcagatggtttcagagctatgctggaaacagc

SEQ ID NO: 64597 - DNA, 70 bp, Artificial Sequence
  Synthetic
gccaagcatttaggtgacactatagacgggcaactaaaactccaagtttcagagctatgctggaaacagc

SEQ ID NO: 64598 - DNA, 70 bp, Artificial Sequence
  Synthetic
gccaagcatttaggtgacactatagtggaaagaaggatgtcaagagtttcagagctatgctggaaacagc

SEQ ID NO: 64599 - DNA, 70 bp, Artificial Sequence
  Synthetic
gccaagcatttaggtgacactatagacagtcagaaggaagtgggagtttcagagctatgctggaaacagc

SEQ ID NO: 64600 - DNA, 70 bp, Artificial Sequence
  Synthetic
gccaagcatttaggtgacactatagcttcgctgccacttcctgaggtttcagagctatgctggaaacagc

SEQ ID NO: 64601 - DNA, 70 bp, Artificial Sequence
  Synthetic
gccaagcatttaggtgacactataggatggcgcacctgatggtcggtttcagagctatgctggaaacagc

SEQ ID NO: 64602 - DNA, 70 bp, Artificial Sequence
  Synthetic
gccaagcatttaggtgacactatagagtaatgtggctatatctgcgtttcagagctatgctggaaacagc

SEQ ID NO: 64603 - DNA, 70 bp, Artificial Sequence
  Synthetic
gccaagcatttaggtgacactatagtttacgtctcccctgtaaaagtttcagagctatgctggaaacagc

SEQ ID NO: 64604 - DNA, 70 bp, Artificial Sequence
  Synthetic
gccaagcatttaggtgacactataggtgctgatgggctggttaccgtttcagagctatgctggaaacagc

SEQ ID NO: 64605 - DNA, 70 bp, Artificial Sequence
  Synthetic
gccaagcatttaggtgacactataggcctcagctgctccttagccgtttcagagctatgctggaaacagc

SEQ ID NO: 64606 - DNA, 70 bp, Artificial Sequence
  Synthetic
gccaagcatttaggtgacactataggtctggctggctcctcactggtttcagagctatgctggaaacagc

SEQ ID NO: 64607 - DNA, 70 bp, Artificial Sequence
  Synthetic
gccaagcatttaggtgacactatagctgggaatccggaatacatagtttcagagctatgctggaaacagc

SEQ ID NO: 64608 - DNA, 70 bp, Artificial Sequence
  Synthetic
gccaagcatttaggtgacactataggatccctgagcagttaggtcgtttcagagctatgctggaaacagc

SEQ ID NO: 64609 - DNA, 70 bp, Artificial Sequence
  Synthetic
gccaagcatttaggtgacactataggctggttgtgcgcaacacctgtttcagagctatgctggaaacagc

SEQ ID NO: 64610 - DNA, 70 bp, Artificial Sequence
  Synthetic
gccaagcatttaggtgacactatagtcttctggtatgggatctgtgtttcagagctatgctggaaacagc

SEQ ID NO: 64611 - DNA, 70 bp, Artificial Sequence
  Synthetic
gccaagcatttaggtgacactatagaaaatactgctactgctcatgtttcagagctatgctggaaacagc

SEQ ID NO: 64612 - DNA, 70 bp, Artificial Sequence
  Synthetic
gccaagcatttaggtgacactatagtgctgcaggactgcccctaggtttcagagctatgctggaaacagc

SEQ ID NO: 64613 - DNA, 70 bp, Artificial Sequence
  Synthetic
gccaagcatttaggtgacactatagaccacccaaaggagcacatggtttcagagctatgctggaaacagc

SEQ ID NO: 64614 - DNA, 70 bp, Artificial Sequence
  Synthetic
gccaagcatttaggtgacactatagtgataccacacatggttaatgtttcagagctatgctggaaacagc

SEQ ID NO: 64615 - DNA, 70 bp, Artificial Sequence
  Synthetic
gccaagcatttaggtgacactataggcccactcccctttacttcagtttcagagctatgctggaaacagc

SEQ ID NO: 64616 - DNA, 70 bp, Artificial Sequence
  Synthetic
gccaagcatttaggtgacactatagtaaaggctttccaaaggcgggtttcagagctatgctggaaacagc

SEQ ID NO: 64617 - DNA, 70 bp, Artificial Sequence
  Synthetic
gccaagcatttaggtgacactatagaagaagaagatgatgaccaagtttcagagctatgctggaaacagc

SEQ ID NO: 64618 - DNA, 70 bp, Artificial Sequence
  Synthetic
gccaagcatttaggtgacactatagaaccaaaacagatgtatgaggtttcagagctatgctggaaacagc

SEQ ID NO: 64619 - DNA, 70 bp, Artificial Sequence
  Synthetic
gccaagcatttaggtgacactatagacaggttagtttttgacagagtttcagagctatgctggaaacagc

SEQ ID NO: 64620 - DNA, 70 bp, Artificial Sequence
  Synthetic
gccaagcatttaggtgacactataggtatctttaggagggtaacagtttcagagctatgctggaaacagc

SEQ ID NO: 64621 - DNA, 70 bp, Artificial Sequence
  Synthetic
gccaagcatttaggtgacactatagaaacggctgttcatttcattgtttcagagctatgctggaaacagc

SEQ ID NO: 64622 - DNA, 70 bp, Artificial Sequence
  Synthetic
gccaagcatttaggtgacactatagagccggctgcggggctcactgtttcagagctatgctggaaacagc

SEQ ID NO: 64623 - DNA, 70 bp, Artificial Sequence
  Synthetic
gccaagcatttaggtgacactatagttcttctgctctcatttgctgtttcagagctatgctggaaacagc

SEQ ID NO: 64624 - DNA, 70 bp, Artificial Sequence
  Synthetic
gccaagcatttaggtgacactataggacatagtcaaacctgagcagtttcagagctatgctggaaacagc

SEQ ID NO: 64625 - DNA, 70 bp, Artificial Sequence
  Synthetic
gccaagcatttaggtgacactatagacatgacatttttgttccaggtttcagagctatgctggaaacagc

SEQ ID NO: 64626 - DNA, 70 bp, Artificial Sequence
  Synthetic
gccaagcatttaggtgacactatagttggacagcctgggtgtgaagtttcagagctatgctggaaacagc

SEQ ID NO: 64627 - DNA, 70 bp, Artificial Sequence
  Synthetic
gccaagcatttaggtgacactatagaatatcaatctacttgctgggtttcagagctatgctggaaacagc

SEQ ID NO: 64628 - DNA, 70 bp, Artificial Sequence
  Synthetic
gccaagcatttaggtgacactatagctcagtgccctgactacaacgtttcagagctatgctggaaacagc

SEQ ID NO: 64629 - DNA, 70 bp, Artificial Sequence
  Synthetic
gccaagcatttaggtgacactatagtgtgtaccagaatcagttgtgtttcagagctatgctggaaacagc

SEQ ID NO: 64630 - DNA, 70 bp, Artificial Sequence
  Synthetic
gccaagcatttaggtgacactataggggttttcgtacttttttgggtttcagagctatgctggaaacagc

SEQ ID NO: 64631 - DNA, 70 bp, Artificial Sequence
  Synthetic
gccaagcatttaggtgacactatagtacaagcagtggaaggaaatgtttcagagctatgctggaaacagc

SEQ ID NO: 64632 - DNA, 70 bp, Artificial Sequence
  Synthetic
gccaagcatttaggtgacactatagcgtgggcccaggtgggctgagtttcagagctatgctggaaacagc

SEQ ID NO: 64633 - DNA, 70 bp, Artificial Sequence
  Synthetic
gccaagcatttaggtgacactatagttgccactttggcctcagtggtttcagagctatgctggaaacagc

SEQ ID NO: 64634 - DNA, 70 bp, Artificial Sequence
  Synthetic
gccaagcatttaggtgacactatagttttggaagagacgaaagaagtttcagagctatgctggaaacagc

SEQ ID NO: 64635 - DNA, 70 bp, Artificial Sequence
  Synthetic
gccaagcatttaggtgacactatagggtgctccgtggggttcttagtttcagagctatgctggaaacagc

SEQ ID NO: 64636 - DNA, 70 bp, Artificial Sequence
  Synthetic
gccaagcatttaggtgacactatagtacagccgcctgctggcctggtttcagagctatgctggaaacagc

SEQ ID NO: 64637 - DNA, 70 bp, Artificial Sequence
  Synthetic
gccaagcatttaggtgacactatagtgtgcacatagtagcctgtggtttcagagctatgctggaaacagc

SEQ ID NO: 64638 - DNA, 70 bp, Artificial Sequence
  Synthetic
gccaagcatttaggtgacactatagggctctaaatatatacctgcgtttcagagctatgctggaaacagc

SEQ ID NO: 64639 - DNA, 70 bp, Artificial Sequence
  Synthetic
gccaagcatttaggtgacactataggatcctcaacatccgattgcgtttcagagctatgctggaaacagc

SEQ ID NO: 64640 - DNA, 70 bp, Artificial Sequence
  Synthetic
gccaagcatttaggtgacactataggtggccgtattggcctagaggtttcagagctatgctggaaacagc

SEQ ID NO: 64641 - DNA, 70 bp, Artificial Sequence
  Synthetic
gccaagcatttaggtgacactatagctcttgcactggtaccctgagtttcagagctatgctggaaacagc

SEQ ID NO: 64642 - DNA, 70 bp, Artificial Sequence
  Synthetic
gccaagcatttaggtgacactatagaacaaaaactggaggctgaagtttcagagctatgctggaaacagc

SEQ ID NO: 64643 - DNA, 70 bp, Artificial Sequence
  Synthetic
gccaagcatttaggtgacactatagtgttttcaagcaaattcacggtttcagagctatgctggaaacagc

SEQ ID NO: 64644 - DNA, 70 bp, Artificial Sequence
  Synthetic
gccaagcatttaggtgacactatagaatgcagacatcaatgactggtttcagagctatgctggaaacagc

SEQ ID NO: 64645 - DNA, 70 bp, Artificial Sequence
  Synthetic
gccaagcatttaggtgacactatagatatcacaaagttagtccacgtttcagagctatgctggaaacagc

SEQ ID NO: 64646 - DNA, 70 bp, Artificial Sequence
  Synthetic
gccaagcatttaggtgacactatagcagtactctgttgcagtgaggtttcagagctatgctggaaacagc

SEQ ID NO: 64647 - DNA, 70 bp, Artificial Sequence
  Synthetic
gccaagcatttaggtgacactatagttttgttcctggttttaacggtttcagagctatgctggaaacagc

SEQ ID NO: 64648 - DNA, 70 bp, Artificial Sequence
  Synthetic
gccaagcatttaggtgacactatagcagaaaacgtgaaactgaaggtttcagagctatgctggaaacagc

SEQ ID NO: 64649 - DNA, 70 bp, Artificial Sequence
  Synthetic
gccaagcatttaggtgacactatagtgacagtgtgcaactctcatgtttcagagctatgctggaaacagc

SEQ ID NO: 64650 - DNA, 70 bp, Artificial Sequence
  Synthetic
gccaagcatttaggtgacactatagcaaagtcaggtgccagaagcgtttcagagctatgctggaaacagc

SEQ ID NO: 64651 - DNA, 70 bp, Artificial Sequence
  Synthetic
gccaagcatttaggtgacactataggggtgagatagcttcattttgtttcagagctatgctggaaacagc

SEQ ID NO: 64652 - DNA, 70 bp, Artificial Sequence
  Synthetic
gccaagcatttaggtgacactatagggtttctgaagactggaaaagtttcagagctatgctggaaacagc

SEQ ID NO: 64653 - DNA, 70 bp, Artificial Sequence
  Synthetic
gccaagcatttaggtgacactatagttctgcttctgctgtgttccgtttcagagctatgctggaaacagc

SEQ ID NO: 64654 - DNA, 70 bp, Artificial Sequence
  Synthetic
gccaagcatttaggtgacactatagagacacagggtcagggttccgtttcagagctatgctggaaacagc

SEQ ID NO: 64655 - DNA, 70 bp, Artificial Sequence
  Synthetic
gccaagcatttaggtgacactataggctagagatttctctaagcggtttcagagctatgctggaaacagc

SEQ ID NO: 64656 - DNA, 70 bp, Artificial Sequence
  Synthetic
gccaagcatttaggtgacactatagctgtgctctttgctctctcagtttcagagctatgctggaaacagc

SEQ ID NO: 64657 - DNA, 70 bp, Artificial Sequence
  Synthetic
gccaagcatttaggtgacactatagacagttttaatagctccctcgtttcagagctatgctggaaacagc

SEQ ID NO: 64658 - DNA, 70 bp, Artificial Sequence
  Synthetic
gccaagcatttaggtgacactataggttgccctgattcccattttgtttcagagctatgctggaaacagc

SEQ ID NO: 64659 - DNA, 70 bp, Artificial Sequence
  Synthetic
gccaagcatttaggtgacactatagccctggtacagaaccatgacgtttcagagctatgctggaaacagc

SEQ ID NO: 64660 - DNA, 70 bp, Artificial Sequence
  Synthetic
gccaagcatttaggtgacactatagttagtctagatttcagggaggtttcagagctatgctggaaacagc

SEQ ID NO: 64661 - DNA, 70 bp, Artificial Sequence
  Synthetic
gccaagcatttaggtgacactatagttcgtcccaaagattttgtcgtttcagagctatgctggaaacagc

SEQ ID NO: 64662 - DNA, 70 bp, Artificial Sequence
  Synthetic
gccaagcatttaggtgacactatagaggagggctagagaaagcaagtttcagagctatgctggaaacagc

SEQ ID NO: 64663 - DNA, 70 bp, Artificial Sequence
  Synthetic
gccaagcatttaggtgacactatagcgctggaggaggagctgagcgtttcagagctatgctggaaacagc

SEQ ID NO: 64664 - DNA, 70 bp, Artificial Sequence
  Synthetic
gccaagcatttaggtgacactatagaggcatttgtgcctgcttgggtttcagagctatgctggaaacagc

SEQ ID NO: 64665 - DNA, 70 bp, Artificial Sequence
  Synthetic
gccaagcatttaggtgacactatagcaaaagggcgattgcatcacgtttcagagctatgctggaaacagc

SEQ ID NO: 64666 - DNA, 70 bp, Artificial Sequence
  Synthetic
gccaagcatttaggtgacactatagtttcttgaaagtgagcagtagtttcagagctatgctggaaacagc

SEQ ID NO: 64667 - DNA, 70 bp, Artificial Sequence
  Synthetic
gccaagcatttaggtgacactatagaagacgcggccggtgtagctgtttcagagctatgctggaaacagc

SEQ ID NO: 64668 - DNA, 70 bp, Artificial Sequence
  Synthetic
gccaagcatttaggtgacactatagtctgcatcagactagcccgtgtttcagagctatgctggaaacagc

SEQ ID NO: 64669 - DNA, 70 bp, Artificial Sequence
  Synthetic
gccaagcatttaggtgacactatagaagacagtatcagagaaggcgtttcagagctatgctggaaacagc

SEQ ID NO: 64670 - DNA, 70 bp, Artificial Sequence
  Synthetic
gccaagcatttaggtgacactatagagtgtcaaattaccgtcgcggtttcagagctatgctggaaacagc

SEQ ID NO: 64671 - DNA, 70 bp, Artificial Sequence
  Synthetic
gccaagcatttaggtgacactatagtcagtgtgaagcgggtgaaggtttcagagctatgctggaaacagc

SEQ ID NO: 64672 - DNA, 70 bp, Artificial Sequence
  Synthetic
gccaagcatttaggtgacactatagacatcatgaagatgttccacgtttcagagctatgctggaaacagc

SEQ ID NO: 64673 - DNA, 70 bp, Artificial Sequence
  Synthetic
gccaagcatttaggtgacactatagtgcctttccatctagcactggtttcagagctatgctggaaacagc

SEQ ID NO: 64674 - DNA, 70 bp, Artificial Sequence
  Synthetic
gccaagcatttaggtgacactatagccagcactactaatcccattgtttcagagctatgctggaaacagc

SEQ ID NO: 64675 - DNA, 70 bp, Artificial Sequence
  Synthetic
gccaagcatttaggtgacactatagggaagtggggacagaaatgggtttcagagctatgctggaaacagc

SEQ ID NO: 64676 - DNA, 70 bp, Artificial Sequence
  Synthetic
gccaagcatttaggtgacactatagtgaatcttctagttcttcaggtttcagagctatgctggaaacagc

SEQ ID NO: 64677 - DNA, 70 bp, Artificial Sequence
  Synthetic
gccaagcatttaggtgacactataggtgctcccaaaggaaagaaagtttcagagctatgctggaaacagc

SEQ ID NO: 64678 - DNA, 70 bp, Artificial Sequence
  Synthetic
gccaagcatttaggtgacactatagccctgtaccagagaatgaaagtttcagagctatgctggaaacagc

SEQ ID NO: 64679 - DNA, 70 bp, Artificial Sequence
  Synthetic
gccaagcatttaggtgacactatagtacatgagtggctatcatacgtttcagagctatgctggaaacagc

SEQ ID NO: 64680 - DNA, 70 bp, Artificial Sequence
  Synthetic
gccaagcatttaggtgacactatagatgcctgacattgtatttaggtttcagagctatgctggaaacagc

SEQ ID NO: 64681 - DNA, 70 bp, Artificial Sequence
  Synthetic
gccaagcatttaggtgacactatagagaactcatggatgcagactgtttcagagctatgctggaaacagc

SEQ ID NO: 64682 - DNA, 70 bp, Artificial Sequence
  Synthetic
gccaagcatttaggtgacactatagggttttctgctccttagacggtttcagagctatgctggaaacagc

SEQ ID NO: 64683 - DNA, 70 bp, Artificial Sequence
  Synthetic
gccaagcatttaggtgacactataggccaaggaaacaaggataaagtttcagagctatgctggaaacagc

SEQ ID NO: 64684 - DNA, 70 bp, Artificial Sequence
  Synthetic
gccaagcatttaggtgacactatagtcttccagcaggggacctgagtttcagagctatgctggaaacagc

SEQ ID NO: 64685 - DNA, 70 bp, Artificial Sequence
  Synthetic
gccaagcatttaggtgacactatagcaagagccagaagttctcacgtttcagagctatgctggaaacagc

SEQ ID NO: 64686 - DNA, 70 bp, Artificial Sequence
  Synthetic
gccaagcatttaggtgacactatagccaaggccactgttttgctagtttcagagctatgctggaaacagc

SEQ ID NO: 64687 - DNA, 70 bp, Artificial Sequence
  Synthetic
gccaagcatttaggtgacactatagtaccgtgtgtaccaaatagagtttcagagctatgctggaaacagc

SEQ ID NO: 64688 - DNA, 70 bp, Artificial Sequence
  Synthetic
gccaagcatttaggtgacactatagactcctggggcagcaggagggtttcagagctatgctggaaacagc

SEQ ID NO: 64689 - DNA, 70 bp, Artificial Sequence
  Synthetic
gccaagcatttaggtgacactatagggtgtcttcgggggaggagggtttcagagctatgctggaaacagc

SEQ ID NO: 64690 - DNA, 70 bp, Artificial Sequence
  Synthetic
gccaagcatttaggtgacactatagggaagctgcaccagccctgagtttcagagctatgctggaaacagc

SEQ ID NO: 64691 - DNA, 70 bp, Artificial Sequence
  Synthetic
gccaagcatttaggtgacactatagctgtttgaggcaatctgcatgtttcagagctatgctggaaacagc

SEQ ID NO: 64692 - DNA, 70 bp, Artificial Sequence
  Synthetic
gccaagcatttaggtgacactataggaaggagctcaaccttcctggtttcagagctatgctggaaacagc

SEQ ID NO: 64693 - DNA, 70 bp, Artificial Sequence
  Synthetic
gccaagcatttaggtgacactataggtcacagcacgagcgtgcacgtttcagagctatgctggaaacagc

SEQ ID NO: 64694 - DNA, 70 bp, Artificial Sequence
  Synthetic
gccaagcatttaggtgacactatagccccaaagctgaacagtagtgtttcagagctatgctggaaacagc

SEQ ID NO: 64695 - DNA, 70 bp, Artificial Sequence
  Synthetic
gccaagcatttaggtgacactataggttgtctgtatttagggtgcgtttcagagctatgctggaaacagc

SEQ ID NO: 64696 - DNA, 70 bp, Artificial Sequence
  Synthetic
gccaagcatttaggtgacactatagccaccccctcctcaaccctagtttcagagctatgctggaaacagc

SEQ ID NO: 64697 - DNA, 70 bp, Artificial Sequence
  Synthetic
gccaagcatttaggtgacactatagtgtgggtattttacactgttgtttcagagctatgctggaaacagc

SEQ ID NO: 64698 - DNA, 70 bp, Artificial Sequence
  Synthetic
gccaagcatttaggtgacactataggagcaggggttaggacttttgtttcagagctatgctggaaacagc

SEQ ID NO: 64699 - DNA, 70 bp, Artificial Sequence
  Synthetic
gccaagcatttaggtgacactataggctagacattcttgccgcgcgtttcagagctatgctggaaacagc

SEQ ID NO: 64700 - DNA, 70 bp, Artificial Sequence
  Synthetic
gccaagcatttaggtgacactatagaagaccaagaagaagtgagggtttcagagctatgctggaaacagc

SEQ ID NO: 64701 - DNA, 70 bp, Artificial Sequence
  Synthetic
gccaagcatttaggtgacactatagggctttactcgaagcgacgcgtttcagagctatgctggaaacagc

SEQ ID NO: 64702 - DNA, 70 bp, Artificial Sequence
  Synthetic
gccaagcatttaggtgacactatagaagatggactcctaaagctcgtttcagagctatgctggaaacagc

SEQ ID NO: 64703 - DNA, 70 bp, Artificial Sequence
  Synthetic
gccaagcatttaggtgacactatagaaagttccaagtttcaaagcgtttcagagctatgctggaaacagc

SEQ ID NO: 64704 - DNA, 70 bp, Artificial Sequence
  Synthetic
gccaagcatttaggtgacactatagggcactcatttcaacagcaggtttcagagctatgctggaaacagc

SEQ ID NO: 64705 - DNA, 70 bp, Artificial Sequence
  Synthetic
gccaagcatttaggtgacactatagggagacctgcgggtttgctggtttcagagctatgctggaaacagc

SEQ ID NO: 64706 - DNA, 70 bp, Artificial Sequence
  Synthetic
gccaagcatttaggtgacactatagagaaacatgtggatttgctggtttcagagctatgctggaaacagc

SEQ ID NO: 64707 - DNA, 70 bp, Artificial Sequence
  Synthetic
gccaagcatttaggtgacactatagctgttccacaagaagcaatggtttcagagctatgctggaaacagc

SEQ ID NO: 64708 - DNA, 70 bp, Artificial Sequence
  Synthetic
gccaagcatttaggtgacactataggaaatgctgcatagtttcaggtttcagagctatgctggaaacagc

SEQ ID NO: 64709 - DNA, 70 bp, Artificial Sequence
  Synthetic
gccaagcatttaggtgacactatagccaacatcagagcatcctaagtttcagagctatgctggaaacagc

SEQ ID NO: 64710 - DNA, 70 bp, Artificial Sequence
  Synthetic
gccaagcatttaggtgacactatagcctgtagggcctgcattgtagtttcagagctatgctggaaacagc

SEQ ID NO: 64711 - DNA, 70 bp, Artificial Sequence
  Synthetic
gccaagcatttaggtgacactataggccagaagatgcagagctgggtttcagagctatgctggaaacagc

SEQ ID NO: 64712 - DNA, 70 bp, Artificial Sequence
  Synthetic
gccaagcatttaggtgacactataggagggagcctcgagggtcaggtttcagagctatgctggaaacagc

SEQ ID NO: 64713 - DNA, 70 bp, Artificial Sequence
  Synthetic
gccaagcatttaggtgacactatagctgcacaaacatgaggaatcgtttcagagctatgctggaaacagc

SEQ ID NO: 64714 - DNA, 70 bp, Artificial Sequence
  Synthetic
gccaagcatttaggtgacactataggccgaccacgtgcctctcaggtttcagagctatgctggaaacagc

SEQ ID NO: 64715 - DNA, 70 bp, Artificial Sequence
  Synthetic
gccaagcatttaggtgacactataggtcaatgagtttctttgctcgtttcagagctatgctggaaacagc

SEQ ID NO: 64716 - DNA, 70 bp, Artificial Sequence
  Synthetic
gccaagcatttaggtgacactataggcaacaaagatgctgggaaggtttcagagctatgctggaaacagc

SEQ ID NO: 64717 - DNA, 70 bp, Artificial Sequence
  Synthetic
gccaagcatttaggtgacactataggacatctaacttgtccacttgtttcagagctatgctggaaacagc

SEQ ID NO: 64718 - DNA, 70 bp, Artificial Sequence
  Synthetic
gccaagcatttaggtgacactatagggatgaagaggctgacctaggtttcagagctatgctggaaacagc

SEQ ID NO: 64719 - DNA, 70 bp, Artificial Sequence
  Synthetic
gccaagcatttaggtgacactatagagacagagactttcctagcagtttcagagctatgctggaaacagc

SEQ ID NO: 64720 - DNA, 70 bp, Artificial Sequence
  Synthetic
gccaagcatttaggtgacactatagattagcggatcttaacatcagtttcagagctatgctggaaacagc

SEQ ID NO: 64721 - DNA, 70 bp, Artificial Sequence
  Synthetic
gccaagcatttaggtgacactatagtcagtgttttctcctcttctgtttcagagctatgctggaaacagc

SEQ ID NO: 64722 - DNA, 70 bp, Artificial Sequence
  Synthetic
gccaagcatttaggtgacactatagagccacccctgccaggtgaggtttcagagctatgctggaaacagc

SEQ ID NO: 64723 - DNA, 70 bp, Artificial Sequence
  Synthetic
gccaagcatttaggtgacactataggcttatccttatgttgatccgtttcagagctatgctggaaacagc

SEQ ID NO: 64724 - DNA, 70 bp, Artificial Sequence
  Synthetic
gccaagcatttaggtgacactatagcacccggaagcggaggcggcgtttcagagctatgctggaaacagc

SEQ ID NO: 64725 - DNA, 70 bp, Artificial Sequence
  Synthetic
gccaagcatttaggtgacactatagccaccacagctagtgagtaggtttcagagctatgctggaaacagc

SEQ ID NO: 64726 - DNA, 70 bp, Artificial Sequence
  Synthetic
gccaagcatttaggtgacactatagtgtgacggaagaggaggagggtttcagagctatgctggaaacagc

SEQ ID NO: 64727 - DNA, 70 bp, Artificial Sequence
  Synthetic
gccaagcatttaggtgacactatagaggctcatctgttatttgccgtttcagagctatgctggaaacagc

SEQ ID NO: 64728 - DNA, 70 bp, Artificial Sequence
  Synthetic
gccaagcatttaggtgacactatagcaaaaaggaccagttgggcagtttcagagctatgctggaaacagc

SEQ ID NO: 64729 - DNA, 70 bp, Artificial Sequence
  Synthetic
gccaagcatttaggtgacactatagggcttatgaaatgccttctggtttcagagctatgctggaaacagc

SEQ ID NO: 64730 - DNA, 70 bp, Artificial Sequence
  Synthetic
gccaagcatttaggtgacactatagaagaagagttcttttgactcgtttcagagctatgctggaaacagc

SEQ ID NO: 64731 - DNA, 70 bp, Artificial Sequence
  Synthetic
gccaagcatttaggtgacactatagcgctagcaaaggaaagaatagtttcagagctatgctggaaacagc

SEQ ID NO: 64732 - DNA, 70 bp, Artificial Sequence
  Synthetic
gccaagcatttaggtgacactatagagtatgagccagaggcgtaggtttcagagctatgctggaaacagc

SEQ ID NO: 64733 - DNA, 70 bp, Artificial Sequence
  Synthetic
gccaagcatttaggtgacactatagccgcccgggacacgctcacagtttcagagctatgctggaaacagc

SEQ ID NO: 64734 - DNA, 70 bp, Artificial Sequence
  Synthetic
gccaagcatttaggtgacactatagccagagtgggggagactagagtttcagagctatgctggaaacagc

SEQ ID NO: 64735 - DNA, 70 bp, Artificial Sequence
  Synthetic
gccaagcatttaggtgacactatagtgccccccaacaggagggtggtttcagagctatgctggaaacagc

SEQ ID NO: 64736 - DNA, 70 bp, Artificial Sequence
  Synthetic
gccaagcatttaggtgacactatagtttggctacagccgctaagggtttcagagctatgctggaaacagc

SEQ ID NO: 64737 - DNA, 70 bp, Artificial Sequence
  Synthetic
gccaagcatttaggtgacactatagcagacactggagaaatcttagtttcagagctatgctggaaacagc

SEQ ID NO: 64738 - DNA, 70 bp, Artificial Sequence
  Synthetic
gccaagcatttaggtgacactataggcccttccacatgcagtcaggtttcagagctatgctggaaacagc

SEQ ID NO: 64739 - DNA, 70 bp, Artificial Sequence
  Synthetic
gccaagcatttaggtgacactatagtgacgaggatgaggaggagggtttcagagctatgctggaaacagc

SEQ ID NO: 64740 - DNA, 70 bp, Artificial Sequence
  Synthetic
gccaagcatttaggtgacactatagcttgcatcctggctcagccggtttcagagctatgctggaaacagc

SEQ ID NO: 64741 - DNA, 70 bp, Artificial Sequence
  Synthetic
gccaagcatttaggtgacactatagggcggctcccagctctgagggtttcagagctatgctggaaacagc

SEQ ID NO: 64742 - DNA, 70 bp, Artificial Sequence
  Synthetic
gccaagcatttaggtgacactatagggggccacagtcagatgacagtttcagagctatgctggaaacagc

SEQ ID NO: 64743 - DNA, 70 bp, Artificial Sequence
  Synthetic
gccaagcatttaggtgacactatagccaggagtacaaattcagcggtttcagagctatgctggaaacagc

SEQ ID NO: 64744 - DNA, 70 bp, Artificial Sequence
  Synthetic
gccaagcatttaggtgacactatagtttccttcatcaaaaagctggtttcagagctatgctggaaacagc

SEQ ID NO: 64745 - DNA, 70 bp, Artificial Sequence
  Synthetic
gccaagcatttaggtgacactatagtctcatgcaatgaaatccaagtttcagagctatgctggaaacagc

SEQ ID NO: 64746 - DNA, 70 bp, Artificial Sequence
  Synthetic
gccaagcatttaggtgacactatagagaaggaaagaggcaagtaggtttcagagctatgctggaaacagc

SEQ ID NO: 64747 - DNA, 70 bp, Artificial Sequence
  Synthetic
gccaagcatttaggtgacactatagagtgacaagagactgtatatgtttcagagctatgctggaaacagc

SEQ ID NO: 64748 - DNA, 70 bp, Artificial Sequence
  Synthetic
gccaagcatttaggtgacactatagagtcgagaagaaggaaagaggtttcagagctatgctggaaacagc

SEQ ID NO: 64749 - DNA, 70 bp, Artificial Sequence
  Synthetic
gccaagcatttaggtgacactataggaggctgcgccggagtgaaggtttcagagctatgctggaaacagc

SEQ ID NO: 64750 - DNA, 70 bp, Artificial Sequence
  Synthetic
gccaagcatttaggtgacactatagggggaaaaggtgctacttctgtttcagagctatgctggaaacagc

SEQ ID NO: 64751 - DNA, 70 bp, Artificial Sequence
  Synthetic
gccaagcatttaggtgacactatagaagaagacacagtcacaaacgtttcagagctatgctggaaacagc

SEQ ID NO: 64752 - DNA, 70 bp, Artificial Sequence
  Synthetic
gccaagcatttaggtgacactatagccaagatgagtctagggcctgtttcagagctatgctggaaacagc

SEQ ID NO: 64753 - DNA, 70 bp, Artificial Sequence
  Synthetic
gccaagcatttaggtgacactatagctgtggccaagggtcaaagagtttcagagctatgctggaaacagc

SEQ ID NO: 64754 - DNA, 70 bp, Artificial Sequence
  Synthetic
gccaagcatttaggtgacactatagcataggtgatcttcatagcagtttcagagctatgctggaaacagc

SEQ ID NO: 64755 - DNA, 70 bp, Artificial Sequence
  Synthetic
gccaagcatttaggtgacactatagatgactcgaccagacagatagtttcagagctatgctggaaacagc

SEQ ID NO: 64756 - DNA, 70 bp, Artificial Sequence
  Synthetic
gccaagcatttaggtgacactatagcttgagagacattatcgcctgtttcagagctatgctggaaacagc

SEQ ID NO: 64757 - DNA, 70 bp, Artificial Sequence
  Synthetic
gccaagcatttaggtgacactatagcgctcatcgccggcaagtaggtttcagagctatgctggaaacagc

SEQ ID NO: 64758 - DNA, 70 bp, Artificial Sequence
  Synthetic
gccaagcatttaggtgacactatagagaggacgtggaatgggacggtttcagagctatgctggaaacagc

SEQ ID NO: 64759 - DNA, 70 bp, Artificial Sequence
  Synthetic
gccaagcatttaggtgacactatagctgggtcggatcatgctaaagtttcagagctatgctggaaacagc

SEQ ID NO: 64760 - DNA, 70 bp, Artificial Sequence
  Synthetic
gccaagcatttaggtgacactatagggaagaagaggaagaagatggtttcagagctatgctggaaacagc

SEQ ID NO: 64761 - DNA, 70 bp, Artificial Sequence
  Synthetic
gccaagcatttaggtgacactataggcataaagacctccaaggaggtttcagagctatgctggaaacagc

SEQ ID NO: 64762 - DNA, 70 bp, Artificial Sequence
  Synthetic
gccaagcatttaggtgacactatagtatcatcatgttagaagcctgtttcagagctatgctggaaacagc

SEQ ID NO: 64763 - DNA, 70 bp, Artificial Sequence
  Synthetic
gccaagcatttaggtgacactatagtcaacagtatgctaaggtctgtttcagagctatgctggaaacagc

SEQ ID NO: 64764 - DNA, 70 bp, Artificial Sequence
  Synthetic
gccaagcatttaggtgacactatagagtcacccgcctcgggctgtgtttcagagctatgctggaaacagc

SEQ ID NO: 64765 - DNA, 70 bp, Artificial Sequence
  Synthetic
gccaagcatttaggtgacactataggattacaagactgggcttgggtttcagagctatgctggaaacagc

SEQ ID NO: 64766 - DNA, 70 bp, Artificial Sequence
  Synthetic
gccaagcatttaggtgacactatagtcggccaaagtcactcgtatgtttcagagctatgctggaaacagc

SEQ ID NO: 64767 - DNA, 70 bp, Artificial Sequence
  Synthetic
gccaagcatttaggtgacactataggcaacaaaggtaatgtgttcgtttcagagctatgctggaaacagc

SEQ ID NO: 64768 - DNA, 70 bp, Artificial Sequence
  Synthetic
gccaagcatttaggtgacactatagtgtatactttgctttgctcggtttcagagctatgctggaaacagc

SEQ ID NO: 64769 - DNA, 70 bp, Artificial Sequence
  Synthetic
gccaagcatttaggtgacactatagaatacatgtacagcagctaagtttcagagctatgctggaaacagc

SEQ ID NO: 64770 - DNA, 70 bp, Artificial Sequence
  Synthetic
gccaagcatttaggtgacactatagtgtgctcatcaagttcagaagtttcagagctatgctggaaacagc

SEQ ID NO: 64771 - DNA, 70 bp, Artificial Sequence
  Synthetic
gccaagcatttaggtgacactatagttagactaagagcctttcaagtttcagagctatgctggaaacagc

SEQ ID NO: 64772 - DNA, 70 bp, Artificial Sequence
  Synthetic
gccaagcatttaggtgacactatagtctctctttaattctccatggtttcagagctatgctggaaacagc

SEQ ID NO: 64773 - DNA, 70 bp, Artificial Sequence
  Synthetic
gccaagcatttaggtgacactatagatatggctttaaccacctctgtttcagagctatgctggaaacagc

SEQ ID NO: 64774 - DNA, 70 bp, Artificial Sequence
  Synthetic
gccaagcatttaggtgacactatagcaagaagaggaggaaggaatgtttcagagctatgctggaaacagc

SEQ ID NO: 64775 - DNA, 70 bp, Artificial Sequence
  Synthetic
gccaagcatttaggtgacactataggggtaagagttcattcacttgtttcagagctatgctggaaacagc

SEQ ID NO: 64776 - DNA, 70 bp, Artificial Sequence
  Synthetic
gccaagcatttaggtgacactatagaggcaaaggccatctcctaagtttcagagctatgctggaaacagc

SEQ ID NO: 64777 - DNA, 70 bp, Artificial Sequence
  Synthetic
gccaagcatttaggtgacactatagacctcagctacctgttctgagtttcagagctatgctggaaacagc

SEQ ID NO: 64778 - DNA, 70 bp, Artificial Sequence
  Synthetic
gccaagcatttaggtgacactatagtaaagtaaatacagctccgcgtttcagagctatgctggaaacagc

SEQ ID NO: 64779 - DNA, 70 bp, Artificial Sequence
  Synthetic
gccaagcatttaggtgacactatagtggtcagttagaaacagtttgtttcagagctatgctggaaacagc

SEQ ID NO: 64780 - DNA, 70 bp, Artificial Sequence
  Synthetic
gccaagcatttaggtgacactataggtggtgagaggggctcctacgtttcagagctatgctggaaacagc

SEQ ID NO: 64781 - DNA, 70 bp, Artificial Sequence
  Synthetic
gccaagcatttaggtgacactatagcagcgttcattctgagccaggtttcagagctatgctggaaacagc

SEQ ID NO: 64782 - DNA, 70 bp, Artificial Sequence
  Synthetic
gccaagcatttaggtgacactatagaagcgccttctttgcagaaagtttcagagctatgctggaaacagc

SEQ ID NO: 64783 - DNA, 70 bp, Artificial Sequence
  Synthetic
gccaagcatttaggtgacactatagagaggatccgatgatggggagtttcagagctatgctggaaacagc

SEQ ID NO: 64784 - DNA, 70 bp, Artificial Sequence
  Synthetic
gccaagcatttaggtgacactatagtaggagacacagtgagaccagtttcagagctatgctggaaacagc

SEQ ID NO: 64785 - DNA, 70 bp, Artificial Sequence
  Synthetic
gccaagcatttaggtgacactatagaagttacctctgtgacatctgtttcagagctatgctggaaacagc

SEQ ID NO: 64786 - DNA, 70 bp, Artificial Sequence
  Synthetic
gccaagcatttaggtgacactatagtctcaactcccaccctaacagtttcagagctatgctggaaacagc

SEQ ID NO: 64787 - DNA, 70 bp, Artificial Sequence
  Synthetic
gccaagcatttaggtgacactatagagagatagaagtagcagaaggtttcagagctatgctggaaacagc

SEQ ID NO: 64788 - DNA, 70 bp, Artificial Sequence
  Synthetic
gccaagcatttaggtgacactatagcttcgagggcattggagatggtttcagagctatgctggaaacagc

SEQ ID NO: 64789 - DNA, 70 bp, Artificial Sequence
  Synthetic
gccaagcatttaggtgacactatagaatgatagcactgtcatcaagtttcagagctatgctggaaacagc

SEQ ID NO: 64790 - DNA, 70 bp, Artificial Sequence
  Synthetic
gccaagcatttaggtgacactataggaagagcttcttccaacttcgtttcagagctatgctggaaacagc

SEQ ID NO: 64791 - DNA, 70 bp, Artificial Sequence
  Synthetic
gccaagcatttaggtgacactataggagcagagacgtggacgcctgtttcagagctatgctggaaacagc

SEQ ID NO: 64792 - DNA, 70 bp, Artificial Sequence
  Synthetic
gccaagcatttaggtgacactataggaagctcagggaaaactgaggtttcagagctatgctggaaacagc

SEQ ID NO: 64793 - DNA, 70 bp, Artificial Sequence
  Synthetic
gccaagcatttaggtgacactatagcaacactggagttcaacacagtttcagagctatgctggaaacagc

SEQ ID NO: 64794 - DNA, 70 bp, Artificial Sequence
  Synthetic
gccaagcatttaggtgacactataggatgggtgtctcctcttagcgtttcagagctatgctggaaacagc

SEQ ID NO: 64795 - DNA, 70 bp, Artificial Sequence
  Synthetic
gccaagcatttaggtgacactatagggatctcagtgcctctgttggtttcagagctatgctggaaacagc

SEQ ID NO: 64796 - DNA, 70 bp, Artificial Sequence
  Synthetic
gccaagcatttaggtgacactatagacaatcttattgctaggcaagtttcagagctatgctggaaacagc

SEQ ID NO: 64797 - DNA, 70 bp, Artificial Sequence
  Synthetic
gccaagcatttaggtgacactatagagggtcttgatatcagggtggtttcagagctatgctggaaacagc

SEQ ID NO: 64798 - DNA, 70 bp, Artificial Sequence
  Synthetic
gccaagcatttaggtgacactatagagtaaaaggagactgctcaagtttcagagctatgctggaaacagc

SEQ ID NO: 64799 - DNA, 70 bp, Artificial Sequence
  Synthetic
gccaagcatttaggtgacactatagcgagaatacctgcactgagcgtttcagagctatgctggaaacagc

SEQ ID NO: 64800 - DNA, 70 bp, Artificial Sequence
  Synthetic
gccaagcatttaggtgacactatagattgctcatcaaggaggtgcgtttcagagctatgctggaaacagc

SEQ ID NO: 64801 - DNA, 70 bp, Artificial Sequence
  Synthetic
gccaagcatttaggtgacactataggggaaggagatggcagccatgtttcagagctatgctggaaacagc

SEQ ID NO: 64802 - DNA, 70 bp, Artificial Sequence
  Synthetic
gccaagcatttaggtgacactatagctctggactgatcagggcatgtttcagagctatgctggaaacagc

SEQ ID NO: 64803 - DNA, 70 bp, Artificial Sequence
  Synthetic
gccaagcatttaggtgacactatagagccatgtaggatttctaccgtttcagagctatgctggaaacagc

SEQ ID NO: 64804 - DNA, 70 bp, Artificial Sequence
  Synthetic
gccaagcatttaggtgacactatagtctaaatgaactctcagctcgtttcagagctatgctggaaacagc

SEQ ID NO: 64805 - DNA, 70 bp, Artificial Sequence
  Synthetic
gccaagcatttaggtgacactatagcgagctcaagtggagaaaaggtttcagagctatgctggaaacagc

SEQ ID NO: 64806 - DNA, 70 bp, Artificial Sequence
  Synthetic
gccaagcatttaggtgacactatagggggataaggaaaggctagggtttcagagctatgctggaaacagc

SEQ ID NO: 64807 - DNA, 70 bp, Artificial Sequence
  Synthetic
gccaagcatttaggtgacactatagtgcggttttgtcgaggtcaggtttcagagctatgctggaaacagc

SEQ ID NO: 64808 - DNA, 70 bp, Artificial Sequence
  Synthetic
gccaagcatttaggtgacactatagcaacgttcgttctgtgccaggtttcagagctatgctggaaacagc

SEQ ID NO: 64809 - DNA, 70 bp, Artificial Sequence
  Synthetic
gccaagcatttaggtgacactatagcagccgccgggtgtcagccagtttcagagctatgctggaaacagc

SEQ ID NO: 64810 - DNA, 70 bp, Artificial Sequence
  Synthetic
gccaagcatttaggtgacactatagtcccaagaaagaactttactgtttcagagctatgctggaaacagc

SEQ ID NO: 64811 - DNA, 70 bp, Artificial Sequence
  Synthetic
gccaagcatttaggtgacactatagctgcgtttttgggaacataagtttcagagctatgctggaaacagc

SEQ ID NO: 64812 - DNA, 70 bp, Artificial Sequence
  Synthetic
gccaagcatttaggtgacactatagtactctaaggctccccctttgtttcagagctatgctggaaacagc

SEQ ID NO: 64813 - DNA, 70 bp, Artificial Sequence
  Synthetic
gccaagcatttaggtgacactataggcccaggcacacgcggtcaggtttcagagctatgctggaaacagc

SEQ ID NO: 64814 - DNA, 70 bp, Artificial Sequence
  Synthetic
gccaagcatttaggtgacactatagtcaagtttggaccaatgctagtttcagagctatgctggaaacagc

SEQ ID NO: 64815 - DNA, 70 bp, Artificial Sequence
  Synthetic
gccaagcatttaggtgacactatagagtcaatacagctctgcaaagtttcagagctatgctggaaacagc

SEQ ID NO: 64816 - DNA, 70 bp, Artificial Sequence
  Synthetic
gccaagcatttaggtgacactatagaactgcctggcagtgttaaagtttcagagctatgctggaaacagc

SEQ ID NO: 64817 - DNA, 70 bp, Artificial Sequence
  Synthetic
gccaagcatttaggtgacactatagcagaggcttcttccaagtgagtttcagagctatgctggaaacagc

SEQ ID NO: 64818 - DNA, 70 bp, Artificial Sequence
  Synthetic
gccaagcatttaggtgacactatagctcagcctcaggcgctagtggtttcagagctatgctggaaacagc

SEQ ID NO: 64819 - DNA, 70 bp, Artificial Sequence
  Synthetic
gccaagcatttaggtgacactatagcagccgctttccagtgatgtgtttcagagctatgctggaaacagc

SEQ ID NO: 64820 - DNA, 70 bp, Artificial Sequence
  Synthetic
gccaagcatttaggtgacactatagaaacacgtaacgacaagtccgtttcagagctatgctggaaacagc

SEQ ID NO: 64821 - DNA, 70 bp, Artificial Sequence
  Synthetic
gccaagcatttaggtgacactatagcttggtcctgccatacctaggtttcagagctatgctggaaacagc

SEQ ID NO: 64822 - DNA, 70 bp, Artificial Sequence
  Synthetic
gccaagcatttaggtgacactatagtggagccgccgctcaaaagggtttcagagctatgctggaaacagc

SEQ ID NO: 64823 - DNA, 70 bp, Artificial Sequence
  Synthetic
gccaagcatttaggtgacactatagcttccccttccagatttgacgtttcagagctatgctggaaacagc

SEQ ID NO: 64824 - DNA, 70 bp, Artificial Sequence
  Synthetic
gccaagcatttaggtgacactatagtggtaaaggcagtccccagagtttcagagctatgctggaaacagc

SEQ ID NO: 64825 - DNA, 70 bp, Artificial Sequence
  Synthetic
gccaagcatttaggtgacactataggtacgatgccccgctttaaggtttcagagctatgctggaaacagc

SEQ ID NO: 64826 - DNA, 70 bp, Artificial Sequence
  Synthetic
gccaagcatttaggtgacactatagtgttactagcattgctgttcgtttcagagctatgctggaaacagc

SEQ ID NO: 64827 - DNA, 70 bp, Artificial Sequence
  Synthetic
gccaagcatttaggtgacactatagagagtttactttgccttgacgtttcagagctatgctggaaacagc

SEQ ID NO: 64828 - DNA, 70 bp, Artificial Sequence
  Synthetic
gccaagcatttaggtgacactataggcctttgccaaacaaaatgagtttcagagctatgctggaaacagc

SEQ ID NO: 64829 - DNA, 70 bp, Artificial Sequence
  Synthetic
gccaagcatttaggtgacactataggtggaaccctccacgtagcggtttcagagctatgctggaaacagc

SEQ ID NO: 64830 - DNA, 70 bp, Artificial Sequence
  Synthetic
gccaagcatttaggtgacactatagacatccaagggaatgtttatgtttcagagctatgctggaaacagc

SEQ ID NO: 64831 - DNA, 70 bp, Artificial Sequence
  Synthetic
gccaagcatttaggtgacactatagaagtgtgttcaaacccatcggtttcagagctatgctggaaacagc

SEQ ID NO: 64832 - DNA, 70 bp, Artificial Sequence
  Synthetic
gccaagcatttaggtgacactatagactgctggggattgatgtgtgtttcagagctatgctggaaacagc

SEQ ID NO: 64833 - DNA, 70 bp, Artificial Sequence
  Synthetic
gccaagcatttaggtgacactataggggtgggggccgcgctcagggtttcagagctatgctggaaacagc

SEQ ID NO: 64834 - DNA, 70 bp, Artificial Sequence
  Synthetic
gccaagcatttaggtgacactataggggaagggggttcacagtatgtttcagagctatgctggaaacagc

SEQ ID NO: 64835 - DNA, 70 bp, Artificial Sequence
  Synthetic
gccaagcatttaggtgacactatagttggctgctctgtcactcgcgtttcagagctatgctggaaacagc

SEQ ID NO: 64836 - DNA, 70 bp, Artificial Sequence
  Synthetic
gccaagcatttaggtgacactatagactcacggaaatgggctcctgtttcagagctatgctggaaacagc

SEQ ID NO: 64837 - DNA, 70 bp, Artificial Sequence
  Synthetic
gccaagcatttaggtgacactataggctcatatcaggtgcttacggtttcagagctatgctggaaacagc

SEQ ID NO: 64838 - DNA, 70 bp, Artificial Sequence
  Synthetic
gccaagcatttaggtgacactatagtccacagcctggctgctagcgtttcagagctatgctggaaacagc

SEQ ID NO: 64839 - DNA, 70 bp, Artificial Sequence
  Synthetic
gccaagcatttaggtgacactatagctctcttcttcattcaagcagtttcagagctatgctggaaacagc

SEQ ID NO: 64840 - DNA, 70 bp, Artificial Sequence
  Synthetic
gccaagcatttaggtgacactatagtgggatgtgtagtgcacgtcgtttcagagctatgctggaaacagc

SEQ ID NO: 64841 - DNA, 70 bp, Artificial Sequence
  Synthetic
gccaagcatttaggtgacactatagacatacaattgggtctggtagtttcagagctatgctggaaacagc

SEQ ID NO: 64842 - DNA, 70 bp, Artificial Sequence
  Synthetic
gccaagcatttaggtgacactatagactttctcttctatagtagggtttcagagctatgctggaaacagc

SEQ ID NO: 64843 - DNA, 70 bp, Artificial Sequence
  Synthetic
gccaagcatttaggtgacactatagtctatagctctagattttgggtttcagagctatgctggaaacagc

SEQ ID NO: 64844 - DNA, 70 bp, Artificial Sequence
  Synthetic
gccaagcatttaggtgacactatagaaaggttttacatagttgccgtttcagagctatgctggaaacagc

SEQ ID NO: 64845 - DNA, 70 bp, Artificial Sequence
  Synthetic
gccaagcatttaggtgacactatagtccccggaaactacgtcaaggtttcagagctatgctggaaacagc

SEQ ID NO: 64846 - DNA, 70 bp, Artificial Sequence
  Synthetic
gccaagcatttaggtgacactatagttacgttgccccggtgtgaggtttcagagctatgctggaaacagc

SEQ ID NO: 64847 - DNA, 70 bp, Artificial Sequence
  Synthetic
gccaagcatttaggtgacactatagaaggtggaatcccagctcatgtttcagagctatgctggaaacagc

SEQ ID NO: 64848 - DNA, 70 bp, Artificial Sequence
  Synthetic
gccaagcatttaggtgacactatagagtgatgtgcatagcagtgagtttcagagctatgctggaaacagc

SEQ ID NO: 64849 - DNA, 70 bp, Artificial Sequence
  Synthetic
gccaagcatttaggtgacactataggctttgattctcagcaactagtttcagagctatgctggaaacagc

SEQ ID NO: 64850 - DNA, 70 bp, Artificial Sequence
  Synthetic
gccaagcatttaggtgacactatagggggcacagtatgcaatttagtttcagagctatgctggaaacagc

SEQ ID NO: 64851 - DNA, 70 bp, Artificial Sequence
  Synthetic
gccaagcatttaggtgacactatagtggggtggcatcagctcaccgtttcagagctatgctggaaacagc

SEQ ID NO: 64852 - DNA, 70 bp, Artificial Sequence
  Synthetic
gccaagcatttaggtgacactatagattaaacactagtgcagttggtttcagagctatgctggaaacagc

SEQ ID NO: 64853 - DNA, 70 bp, Artificial Sequence
  Synthetic
gccaagcatttaggtgacactatagcccattaacatcagggattcgtttcagagctatgctggaaacagc

SEQ ID NO: 64854 - DNA, 70 bp, Artificial Sequence
  Synthetic
gccaagcatttaggtgacactataggctctttcaggctatcaccagtttcagagctatgctggaaacagc

SEQ ID NO: 64855 - DNA, 70 bp, Artificial Sequence
  Synthetic
gccaagcatttaggtgacactatagctctgaagagctattccaaggtttcagagctatgctggaaacagc

SEQ ID NO: 64856 - DNA, 70 bp, Artificial Sequence
  Synthetic
gccaagcatttaggtgacactatagacagaggaactcaggaagaagtttcagagctatgctggaaacagc

SEQ ID NO: 64857 - DNA, 70 bp, Artificial Sequence
  Synthetic
gccaagcatttaggtgacactatagacatatggctaaggtcattggtttcagagctatgctggaaacagc

SEQ ID NO: 64858 - DNA, 70 bp, Artificial Sequence
  Synthetic
gccaagcatttaggtgacactataggggcgcgggcgggctctagtgtttcagagctatgctggaaacagc

SEQ ID NO: 64859 - DNA, 70 bp, Artificial Sequence
  Synthetic
gccaagcatttaggtgacactatagctaactcatgctgtgcttgcgtttcagagctatgctggaaacagc

SEQ ID NO: 64860 - DNA, 70 bp, Artificial Sequence
  Synthetic
gccaagcatttaggtgacactataggtttgcctccaacaacctgagtttcagagctatgctggaaacagc

SEQ ID NO: 64861 - DNA, 70 bp, Artificial Sequence
  Synthetic
gccaagcatttaggtgacactataggaagagtatagtgactgagggtttcagagctatgctggaaacagc

SEQ ID NO: 64862 - DNA, 70 bp, Artificial Sequence
  Synthetic
gccaagcatttaggtgacactatagagaccaaagtccaatgtattgtttcagagctatgctggaaacagc

SEQ ID NO: 64863 - DNA, 70 bp, Artificial Sequence
  Synthetic
gccaagcatttaggtgacactatagtcattccaggaccgttgacagtttcagagctatgctggaaacagc

SEQ ID NO: 64864 - DNA, 70 bp, Artificial Sequence
  Synthetic
gccaagcatttaggtgacactataggaaggcgctagatgtgcgtcgtttcagagctatgctggaaacagc

SEQ ID NO: 64865 - DNA, 70 bp, Artificial Sequence
  Synthetic
gccaagcatttaggtgacactatagacactgtcccggccctaaaggtttcagagctatgctggaaacagc

SEQ ID NO: 64866 - DNA, 70 bp, Artificial Sequence
  Synthetic
gccaagcatttaggtgacactatagcctggtgttcacatattgaagtttcagagctatgctggaaacagc

SEQ ID NO: 64867 - DNA, 70 bp, Artificial Sequence
  Synthetic
gccaagcatttaggtgacactatagccgctgacggtgggctcagtgtttcagagctatgctggaaacagc

SEQ ID NO: 64868 - DNA, 70 bp, Artificial Sequence
  Synthetic
gccaagcatttaggtgacactataggaagagcgatggggagttgggtttcagagctatgctggaaacagc

SEQ ID NO: 64869 - DNA, 70 bp, Artificial Sequence
  Synthetic
gccaagcatttaggtgacactataggggccgggctgggggttacagtttcagagctatgctggaaacagc

SEQ ID NO: 64870 - DNA, 70 bp, Artificial Sequence
  Synthetic
gccaagcatttaggtgacactatagtctgcgtccatgagggttaggtttcagagctatgctggaaacagc

SEQ ID NO: 64871 - DNA, 70 bp, Artificial Sequence
  Synthetic
gccaagcatttaggtgacactatagcaactatcctgacgtgtgacgtttcagagctatgctggaaacagc

SEQ ID NO: 64872 - DNA, 70 bp, Artificial Sequence
  Synthetic
gccaagcatttaggtgacactatagggcggcgccggcggcctagcgtttcagagctatgctggaaacagc

SEQ ID NO: 64873 - DNA, 70 bp, Artificial Sequence
  Synthetic
gccaagcatttaggtgacactatagtgcccctctcacacatgtgagtttcagagctatgctggaaacagc

SEQ ID NO: 64874 - DNA, 70 bp, Artificial Sequence
  Synthetic
gccaagcatttaggtgacactatagggccccgcggggtcatagcggtttcagagctatgctggaaacagc

SEQ ID NO: 64875 - DNA, 70 bp, Artificial Sequence
  Synthetic
gccaagcatttaggtgacactatagcgcaggccggtgctcagatggtttcagagctatgctggaaacagc

SEQ ID NO: 64876 - DNA, 70 bp, Artificial Sequence
  Synthetic
gccaagcatttaggtgacactataggacaggtacccaaaacatgagtttcagagctatgctggaaacagc

SEQ ID NO: 64877 - DNA, 70 bp, Artificial Sequence
  Synthetic
gccaagcatttaggtgacactatagggaagaagaaaaagtgctcagtttcagagctatgctggaaacagc

SEQ ID NO: 64878 - DNA, 70 bp, Artificial Sequence
  Synthetic
gccaagcatttaggtgacactatagcctggttttcacctactgaagtttcagagctatgctggaaacagc

SEQ ID NO: 64879 - DNA, 70 bp, Artificial Sequence
  Synthetic
gccaagcatttaggtgacactataggcaggacaagccaactgatagtttcagagctatgctggaaacagc

SEQ ID NO: 64880 - DNA, 70 bp, Artificial Sequence
  Synthetic
gccaagcatttaggtgacactataggcaaacaaaaactcctcagtgtttcagagctatgctggaaacagc

SEQ ID NO: 64881 - DNA, 70 bp, Artificial Sequence
  Synthetic
gccaagcatttaggtgacactatagactgtagctgttgtagtacggtttcagagctatgctggaaacagc

SEQ ID NO: 64882 - DNA, 70 bp, Artificial Sequence
  Synthetic
gccaagcatttaggtgacactatagccaccctgaccaggccctgagtttcagagctatgctggaaacagc

SEQ ID NO: 64883 - DNA, 70 bp, Artificial Sequence
  Synthetic
gccaagcatttaggtgacactatagcagctcactcgaccttgagggtttcagagctatgctggaaacagc

SEQ ID NO: 64884 - DNA, 70 bp, Artificial Sequence
  Synthetic
gccaagcatttaggtgacactatagtccattaatatcagtggcaagtttcagagctatgctggaaacagc

SEQ ID NO: 64885 - DNA, 70 bp, Artificial Sequence
  Synthetic
gccaagcatttaggtgacactatagtgaagaggatgaacaagagggtttcagagctatgctggaaacagc

SEQ ID NO: 64886 - DNA, 70 bp, Artificial Sequence
  Synthetic
gccaagcatttaggtgacactatagaccaccaagcacaagaaaaagtttcagagctatgctggaaacagc

SEQ ID NO: 64887 - DNA, 70 bp, Artificial Sequence
  Synthetic
gccaagcatttaggtgacactatagagggtcaggtaaagaagattgtttcagagctatgctggaaacagc

SEQ ID NO: 64888 - DNA, 70 bp, Artificial Sequence
  Synthetic
gccaagcatttaggtgacactatagcagactgggaattcaagtacgtttcagagctatgctggaaacagc

SEQ ID NO: 64889 - DNA, 70 bp, Artificial Sequence
  Synthetic
gccaagcatttaggtgacactatagaagccaatgacggcggtttcgtttcagagctatgctggaaacagc

SEQ ID NO: 64890 - DNA, 70 bp, Artificial Sequence
  Synthetic
gccaagcatttaggtgacactatagcgttgtgaaggaatgaccctgtttcagagctatgctggaaacagc

SEQ ID NO: 64891 - DNA, 70 bp, Artificial Sequence
  Synthetic
gccaagcatttaggtgacactatagaacaaatgggaacaattgacgtttcagagctatgctggaaacagc

SEQ ID NO: 64892 - DNA, 70 bp, Artificial Sequence
  Synthetic
gccaagcatttaggtgacactatagcacatactggtacactgagggtttcagagctatgctggaaacagc

SEQ ID NO: 64893 - DNA, 70 bp, Artificial Sequence
  Synthetic
gccaagcatttaggtgacactatagaacaaatgggaacagttgacgtttcagagctatgctggaaacagc

SEQ ID NO: 64894 - DNA, 70 bp, Artificial Sequence
  Synthetic
gccaagcatttaggtgacactatagctggtcacgaagaacttgtagtttcagagctatgctggaaacagc

SEQ ID NO: 64895 - DNA, 70 bp, Artificial Sequence
  Synthetic
gccaagcatttaggtgacactatagagtttctggaaatgagacaagtttcagagctatgctggaaacagc

SEQ ID NO: 64896 - DNA, 70 bp, Artificial Sequence
  Synthetic
gccaagcatttaggtgacactatagtcccaatgtttcaaccaacagtttcagagctatgctggaaacagc

SEQ ID NO: 64897 - DNA, 70 bp, Artificial Sequence
  Synthetic
gccaagcatttaggtgacactatagccacctccgggagggctcacgtttcagagctatgctggaaacagc

SEQ ID NO: 64898 - DNA, 70 bp, Artificial Sequence
  Synthetic
gccaagcatttaggtgacactataggcggcactgaggagctcagtgtttcagagctatgctggaaacagc

SEQ ID NO: 64899 - DNA, 70 bp, Artificial Sequence
  Synthetic
gccaagcatttaggtgacactatagaacttgctggagatctgagcgtttcagagctatgctggaaacagc

SEQ ID NO: 64900 - DNA, 70 bp, Artificial Sequence
  Synthetic
gccaagcatttaggtgacactatagcgcagggtgggcgtcactctgtttcagagctatgctggaaacagc

SEQ ID NO: 64901 - DNA, 70 bp, Artificial Sequence
  Synthetic
gccaagcatttaggtgacactatagggaggcaaggaagcagcgtcgtttcagagctatgctggaaacagc

SEQ ID NO: 64902 - DNA, 70 bp, Artificial Sequence
  Synthetic
gccaagcatttaggtgacactataggggacacatagccagagagggtttcagagctatgctggaaacagc

SEQ ID NO: 64903 - DNA, 70 bp, Artificial Sequence
  Synthetic
gccaagcatttaggtgacactatagtggggcttaggagagctctggtttcagagctatgctggaaacagc

SEQ ID NO: 64904 - DNA, 70 bp, Artificial Sequence
  Synthetic
gccaagcatttaggtgacactatagcttaaagcatcatcttcaccgtttcagagctatgctggaaacagc

SEQ ID NO: 64905 - DNA, 70 bp, Artificial Sequence
  Synthetic
gccaagcatttaggtgacactatagctttggactacgaggctgatgtttcagagctatgctggaaacagc

SEQ ID NO: 64906 - DNA, 70 bp, Artificial Sequence
  Synthetic
gccaagcatttaggtgacactataggatggctgtgacttctaggagtttcagagctatgctggaaacagc

SEQ ID NO: 64907 - DNA, 70 bp, Artificial Sequence
  Synthetic
gccaagcatttaggtgacactataggctctgcgtcttagaaccaggtttcagagctatgctggaaacagc

SEQ ID NO: 64908 - DNA, 70 bp, Artificial Sequence
  Synthetic
gccaagcatttaggtgacactatagatttatctgaatggctcaaggtttcagagctatgctggaaacagc

SEQ ID NO: 64909 - DNA, 70 bp, Artificial Sequence
  Synthetic
gccaagcatttaggtgacactatagttctttcgatggtactgcaggtttcagagctatgctggaaacagc

SEQ ID NO: 64910 - DNA, 70 bp, Artificial Sequence
  Synthetic
gccaagcatttaggtgacactatagaggagccaaggcagtcagtggtttcagagctatgctggaaacagc

SEQ ID NO: 64911 - DNA, 70 bp, Artificial Sequence
  Synthetic
gccaagcatttaggtgacactatagctccgagaagttgccgcgcagtttcagagctatgctggaaacagc

SEQ ID NO: 64912 - DNA, 70 bp, Artificial Sequence
  Synthetic
gccaagcatttaggtgacactatagctgagttacaatttcccaccgtttcagagctatgctggaaacagc

SEQ ID NO: 64913 - DNA, 70 bp, Artificial Sequence
  Synthetic
gccaagcatttaggtgacactatagaaagctcatactgcctttttgtttcagagctatgctggaaacagc

SEQ ID NO: 64914 - DNA, 70 bp, Artificial Sequence
  Synthetic
gccaagcatttaggtgacactatagcacagacaacgctgtggatagtttcagagctatgctggaaacagc

SEQ ID NO: 64915 - DNA, 70 bp, Artificial Sequence
  Synthetic
gccaagcatttaggtgacactatagatggtatttctaattcccgggtttcagagctatgctggaaacagc

SEQ ID NO: 64916 - DNA, 70 bp, Artificial Sequence
  Synthetic
gccaagcatttaggtgacactatagcagagatggatggcagatctgtttcagagctatgctggaaacagc

SEQ ID NO: 64917 - DNA, 70 bp, Artificial Sequence
  Synthetic
gccaagcatttaggtgacactataggttgactgcaggagaagtgagtttcagagctatgctggaaacagc

SEQ ID NO: 64918 - DNA, 70 bp, Artificial Sequence
  Synthetic
gccaagcatttaggtgacactatagctacacccagattatgctttgtttcagagctatgctggaaacagc

SEQ ID NO: 64919 - DNA, 70 bp, Artificial Sequence
  Synthetic
gccaagcatttaggtgacactatagctgacggcacagttcgaacggtttcagagctatgctggaaacagc

SEQ ID NO: 64920 - DNA, 70 bp, Artificial Sequence
  Synthetic
gccaagcatttaggtgacactatagagacatgaagactccaagtggtttcagagctatgctggaaacagc

SEQ ID NO: 64921 - DNA, 70 bp, Artificial Sequence
  Synthetic
gccaagcatttaggtgacactataggggcagagggcagtgcacaggtttcagagctatgctggaaacagc

SEQ ID NO: 64922 - DNA, 70 bp, Artificial Sequence
  Synthetic
gccaagcatttaggtgacactatagcaaagaactacagggattgcgtttcagagctatgctggaaacagc

SEQ ID NO: 64923 - DNA, 70 bp, Artificial Sequence
  Synthetic
gccaagcatttaggtgacactatagagatacacttctgcagaggggtttcagagctatgctggaaacagc

SEQ ID NO: 64924 - DNA, 70 bp, Artificial Sequence
  Synthetic
gccaagcatttaggtgacactatagtgcaagtttgtgcactttttgtttcagagctatgctggaaacagc

SEQ ID NO: 64925 - DNA, 70 bp, Artificial Sequence
  Synthetic
gccaagcatttaggtgacactatagagctgggcggggcgcctagggtttcagagctatgctggaaacagc

SEQ ID NO: 64926 - DNA, 70 bp, Artificial Sequence
  Synthetic
gccaagcatttaggtgacactataggaggacagaggctggtgagggtttcagagctatgctggaaacagc

SEQ ID NO: 64927 - DNA, 70 bp, Artificial Sequence
  Synthetic
gccaagcatttaggtgacactataggagaatgactcctttctgaggtttcagagctatgctggaaacagc

SEQ ID NO: 64928 - DNA, 70 bp, Artificial Sequence
  Synthetic
gccaagcatttaggtgacactatagatagtgtggcaagtgatgtagtttcagagctatgctggaaacagc

SEQ ID NO: 64929 - DNA, 70 bp, Artificial Sequence
  Synthetic
gccaagcatttaggtgacactatagaggctggaagtctgggatcagtttcagagctatgctggaaacagc

SEQ ID NO: 64930 - DNA, 70 bp, Artificial Sequence
  Synthetic
gccaagcatttaggtgacactataggaacattgtggcagatagtggtttcagagctatgctggaaacagc

SEQ ID NO: 64931 - DNA, 70 bp, Artificial Sequence
  Synthetic
gccaagcatttaggtgacactatagccccgaccaaatggaggagggtttcagagctatgctggaaacagc

SEQ ID NO: 64932 - DNA, 70 bp, Artificial Sequence
  Synthetic
gccaagcatttaggtgacactataggtagcttcttgctactttgcgtttcagagctatgctggaaacagc

SEQ ID NO: 64933 - DNA, 70 bp, Artificial Sequence
  Synthetic
gccaagcatttaggtgacactatagatcttcacaggagggtgggggtttcagagctatgctggaaacagc

SEQ ID NO: 64934 - DNA, 70 bp, Artificial Sequence
  Synthetic
gccaagcatttaggtgacactatagatcttcacaggacagtgggggtttcagagctatgctggaaacagc

SEQ ID NO: 64935 - DNA, 70 bp, Artificial Sequence
  Synthetic
gccaagcatttaggtgacactatagcaggatctccacaggatggtgtttcagagctatgctggaaacagc

SEQ ID NO: 64936 - DNA, 70 bp, Artificial Sequence
  Synthetic
gccaagcatttaggtgacactatagtgatggagttctctcaggacgtttcagagctatgctggaaacagc

SEQ ID NO: 64937 - DNA, 70 bp, Artificial Sequence
  Synthetic
gccaagcatttaggtgacactataggatgagtgggccggctgcttgtttcagagctatgctggaaacagc

SEQ ID NO: 64938 - DNA, 70 bp, Artificial Sequence
  Synthetic
gccaagcatttaggtgacactatagtgttgttctgcctggagacagtttcagagctatgctggaaacagc

SEQ ID NO: 64939 - DNA, 70 bp, Artificial Sequence
  Synthetic
gccaagcatttaggtgacactatagaaggagtggggccactgcttgtttcagagctatgctggaaacagc

SEQ ID NO: 64940 - DNA, 70 bp, Artificial Sequence
  Synthetic
gccaagcatttaggtgacactataggcagacgaaggaagtaaagggtttcagagctatgctggaaacagc

SEQ ID NO: 64941 - DNA, 70 bp, Artificial Sequence
  Synthetic
gccaagcatttaggtgacactatagtttggagataccactgtttagtttcagagctatgctggaaacagc

SEQ ID NO: 64942 - DNA, 70 bp, Artificial Sequence
  Synthetic
gccaagcatttaggtgacactatagacgaacattgaaaactgaacgtttcagagctatgctggaaacagc

SEQ ID NO: 64943 - DNA, 70 bp, Artificial Sequence
  Synthetic
gccaagcatttaggtgacactatagatgtgtgtgtatgtgtgtgtgtttcagagctatgctggaaacagc

SEQ ID NO: 64944 - DNA, 70 bp, Artificial Sequence
  Synthetic
gccaagcatttaggtgacactatagcagcctcctgttttcatttcgtttcagagctatgctggaaacagc

SEQ ID NO: 64945 - DNA, 70 bp, Artificial Sequence
  Synthetic
gccaagcatttaggtgacactataggacttcaaactgttcagcaagtttcagagctatgctggaaacagc

SEQ ID NO: 64946 - DNA, 70 bp, Artificial Sequence
  Synthetic
gccaagcatttaggtgacactatagaagctggacagattgtataagtttcagagctatgctggaaacagc

SEQ ID NO: 64947 - DNA, 70 bp, Artificial Sequence
  Synthetic
gccaagcatttaggtgacactatagagtccttctccaataagatggtttcagagctatgctggaaacagc

SEQ ID NO: 64948 - DNA, 70 bp, Artificial Sequence
  Synthetic
gccaagcatttaggtgacactatagctgttgctctcagcagtctggtttcagagctatgctggaaacagc

SEQ ID NO: 64949 - DNA, 70 bp, Artificial Sequence
  Synthetic
gccaagcatttaggtgacactatagcatctcgtgtacagatagacgtttcagagctatgctggaaacagc

SEQ ID NO: 64950 - DNA, 70 bp, Artificial Sequence
  Synthetic
gccaagcatttaggtgacactatagtagtagttttcgtaattcgcgtttcagagctatgctggaaacagc

SEQ ID NO: 64951 - DNA, 70 bp, Artificial Sequence
  Synthetic
gccaagcatttaggtgacactatagtcaggcctccagagggtcaggtttcagagctatgctggaaacagc

SEQ ID NO: 64952 - DNA, 70 bp, Artificial Sequence
  Synthetic
gccaagcatttaggtgacactatagctgcaattttgacaaatgccgtttcagagctatgctggaaacagc

SEQ ID NO: 64953 - DNA, 70 bp, Artificial Sequence
  Synthetic
gccaagcatttaggtgacactatagtccagaagacaacaccctgagtttcagagctatgctggaaacagc

SEQ ID NO: 64954 - DNA, 70 bp, Artificial Sequence
  Synthetic
gccaagcatttaggtgacactataggcggccattttatttttcccgtttcagagctatgctggaaacagc

SEQ ID NO: 64955 - DNA, 70 bp, Artificial Sequence
  Synthetic
gccaagcatttaggtgacactatagtcctggctcctgcttgtagagtttcagagctatgctggaaacagc

SEQ ID NO: 64956 - DNA, 70 bp, Artificial Sequence
  Synthetic
gccaagcatttaggtgacactataggggcccagctggcctagggcgtttcagagctatgctggaaacagc

SEQ ID NO: 64957 - DNA, 70 bp, Artificial Sequence
  Synthetic
gccaagcatttaggtgacactatagcaaggattcagtgatgtagtgtttcagagctatgctggaaacagc

SEQ ID NO: 64958 - DNA, 70 bp, Artificial Sequence
  Synthetic
gccaagcatttaggtgacactatagctttgggaaggtatctgattgtttcagagctatgctggaaacagc

SEQ ID NO: 64959 - DNA, 70 bp, Artificial Sequence
  Synthetic
gccaagcatttaggtgacactatagaaagacagtgccttggtcaggtttcagagctatgctggaaacagc

SEQ ID NO: 64960 - DNA, 70 bp, Artificial Sequence
  Synthetic
gccaagcatttaggtgacactatagtctgatttgtctgtctctgtgtttcagagctatgctggaaacagc

SEQ ID NO: 64961 - DNA, 70 bp, Artificial Sequence
  Synthetic
gccaagcatttaggtgacactatagaggagtgaattattttgtgggtttcagagctatgctggaaacagc

SEQ ID NO: 64962 - DNA, 70 bp, Artificial Sequence
  Synthetic
gccaagcatttaggtgacactatagggccccacagcatcctcatagtttcagagctatgctggaaacagc

SEQ ID NO: 64963 - DNA, 70 bp, Artificial Sequence
  Synthetic
gccaagcatttaggtgacactataggaagactggtctagttcagggtttcagagctatgctggaaacagc

SEQ ID NO: 64964 - DNA, 70 bp, Artificial Sequence
  Synthetic
gccaagcatttaggtgacactataggttctgtctagtcatttctcgtttcagagctatgctggaaacagc

SEQ ID NO: 64965 - DNA, 70 bp, Artificial Sequence
  Synthetic
gccaagcatttaggtgacactatagcccgccgccggcagcttcgcgtttcagagctatgctggaaacagc

SEQ ID NO: 64966 - DNA, 70 bp, Artificial Sequence
  Synthetic
gccaagcatttaggtgacactatagattataggcgtctgctgtacgtttcagagctatgctggaaacagc

SEQ ID NO: 64967 - DNA, 70 bp, Artificial Sequence
  Synthetic
gccaagcatttaggtgacactatagttcttgtccatgtttctgatgtttcagagctatgctggaaacagc

SEQ ID NO: 64968 - DNA, 70 bp, Artificial Sequence
  Synthetic
gccaagcatttaggtgacactataggctgagtctccttgctcacagtttcagagctatgctggaaacagc

SEQ ID NO: 64969 - DNA, 70 bp, Artificial Sequence
  Synthetic
gccaagcatttaggtgacactatagatctctctagagacataagtgtttcagagctatgctggaaacagc

SEQ ID NO: 64970 - DNA, 70 bp, Artificial Sequence
  Synthetic
gccaagcatttaggtgacactatagaagaaaccatagactactaggtttcagagctatgctggaaacagc

SEQ ID NO: 64971 - DNA, 70 bp, Artificial Sequence
  Synthetic
gccaagcatttaggtgacactatagaaggctttggccaatgagaggtttcagagctatgctggaaacagc

SEQ ID NO: 64972 - DNA, 70 bp, Artificial Sequence
  Synthetic
gccaagcatttaggtgacactatagtaaaaacgtctcaatgactcgtttcagagctatgctggaaacagc

SEQ ID NO: 64973 - DNA, 70 bp, Artificial Sequence
  Synthetic
gccaagcatttaggtgacactatagaaggagctgaaaaaatgaaggtttcagagctatgctggaaacagc

SEQ ID NO: 64974 - DNA, 70 bp, Artificial Sequence
  Synthetic
gccaagcatttaggtgacactataggaaggattttctaacgtggagtttcagagctatgctggaaacagc

SEQ ID NO: 64975 - DNA, 70 bp, Artificial Sequence
  Synthetic
gccaagcatttaggtgacactatagtagttctgcttcacatacacgtttcagagctatgctggaaacagc

SEQ ID NO: 64976 - DNA, 70 bp, Artificial Sequence
  Synthetic
gccaagcatttaggtgacactatagtgcagtgagtatttcttcaggtttcagagctatgctggaaacagc

SEQ ID NO: 64977 - DNA, 70 bp, Artificial Sequence
  Synthetic
gccaagcatttaggtgacactataggagcattgaggactgcccttgtttcagagctatgctggaaacagc

SEQ ID NO: 64978 - DNA, 70 bp, Artificial Sequence
  Synthetic
gccaagcatttaggtgacactatagtcctgtttcacccatattgcgtttcagagctatgctggaaacagc

SEQ ID NO: 64979 - DNA, 70 bp, Artificial Sequence
  Synthetic
gccaagcatttaggtgacactatagttggagcttagctcggagctgtttcagagctatgctggaaacagc

SEQ ID NO: 64980 - DNA, 70 bp, Artificial Sequence
  Synthetic
gccaagcatttaggtgacactataggctcattcatttcagctgatgtttcagagctatgctggaaacagc

SEQ ID NO: 64981 - DNA, 70 bp, Artificial Sequence
  Synthetic
gccaagcatttaggtgacactatagacggcaagcccatgttcatcgtttcagagctatgctggaaacagc

SEQ ID NO: 64982 - DNA, 70 bp, Artificial Sequence
  Synthetic
gccaagcatttaggtgacactatagctcatccagcttgtggtcacgtttcagagctatgctggaaacagc

SEQ ID NO: 64983 - DNA, 70 bp, Artificial Sequence
  Synthetic
gccaagcatttaggtgacactatagcgggcgcggggcggctcaccgtttcagagctatgctggaaacagc

SEQ ID NO: 64984 - DNA, 70 bp, Artificial Sequence
  Synthetic
gccaagcatttaggtgacactataggtttatgctcaggattgtctgtttcagagctatgctggaaacagc

SEQ ID NO: 64985 - DNA, 70 bp, Artificial Sequence
  Synthetic
gccaagcatttaggtgacactataggttcacggcttcagtctgaggtttcagagctatgctggaaacagc

SEQ ID NO: 64986 - DNA, 70 bp, Artificial Sequence
  Synthetic
gccaagcatttaggtgacactatagagtcccggctgtgacgttgggtttcagagctatgctggaaacagc

SEQ ID NO: 64987 - DNA, 70 bp, Artificial Sequence
  Synthetic
gccaagcatttaggtgacactatagacagtgcacaagggttaaaagtttcagagctatgctggaaacagc

SEQ ID NO: 64988 - DNA, 70 bp, Artificial Sequence
  Synthetic
gccaagcatttaggtgacactataggtggacaccgagtggtagccgtttcagagctatgctggaaacagc

SEQ ID NO: 64989 - DNA, 70 bp, Artificial Sequence
  Synthetic
gccaagcatttaggtgacactatagtttcacatctgtgacgggatgtttcagagctatgctggaaacagc

SEQ ID NO: 64990 - DNA, 70 bp, Artificial Sequence
  Synthetic
gccaagcatttaggtgacactatagtcggaaagcttttactgccagtttcagagctatgctggaaacagc

SEQ ID NO: 64991 - DNA, 70 bp, Artificial Sequence
  Synthetic
gccaagcatttaggtgacactatagcacagacgacaagaaaccaggtttcagagctatgctggaaacagc

SEQ ID NO: 64992 - DNA, 70 bp, Artificial Sequence
  Synthetic
gccaagcatttaggtgacactatagtttctatggcaagactgtcagtttcagagctatgctggaaacagc

SEQ ID NO: 64993 - DNA, 70 bp, Artificial Sequence
  Synthetic
gccaagcatttaggtgacactatagctacctcttgtgacaggatcgtttcagagctatgctggaaacagc

SEQ ID NO: 64994 - DNA, 70 bp, Artificial Sequence
  Synthetic
gccaagcatttaggtgacactatagccctgggccaggcactcagagtttcagagctatgctggaaacagc

SEQ ID NO: 64995 - DNA, 70 bp, Artificial Sequence
  Synthetic
gccaagcatttaggtgacactatagaagacaagtctttactgttggtttcagagctatgctggaaacagc

SEQ ID NO: 64996 - DNA, 70 bp, Artificial Sequence
  Synthetic
gccaagcatttaggtgacactatagtaaactgattgcaaagggaagtttcagagctatgctggaaacagc

SEQ ID NO: 64997 - DNA, 70 bp, Artificial Sequence
  Synthetic
gccaagcatttaggtgacactatagacaggaagtgaagaatgagagtttcagagctatgctggaaacagc

SEQ ID NO: 64998 - DNA, 70 bp, Artificial Sequence
  Synthetic
gccaagcatttaggtgacactatagcaagcttatactggttctgagtttcagagctatgctggaaacagc

SEQ ID NO: 64999 - DNA, 70 bp, Artificial Sequence
  Synthetic
gccaagcatttaggtgacactatagcctgcagagcttcagtgcccgtttcagagctatgctggaaacagc

SEQ ID NO: 65000 - DNA, 70 bp, Artificial Sequence
  Synthetic
gccaagcatttaggtgacactatagggtttccccagaggagttgggtttcagagctatgctggaaacagc

SEQ ID NO: 65001 - DNA, 70 bp, Artificial Sequence
  Synthetic
gccaagcatttaggtgacactatagggtttcccgggaggagttgggtttcagagctatgctggaaacagc

SEQ ID NO: 65002 - DNA, 70 bp, Artificial Sequence
  Synthetic
gccaagcatttaggtgacactatagttgggtttccctggaggagtgtttcagagctatgctggaaacagc

SEQ ID NO: 65003 - DNA, 70 bp, Artificial Sequence
  Synthetic
gccaagcatttaggtgacactatagggtttccccggaggagttgggtttcagagctatgctggaaacagc

SEQ ID NO: 65004 - DNA, 70 bp, Artificial Sequence
  Synthetic
gccaagcatttaggtgacactatagccccggagctctaggaaatggtttcagagctatgctggaaacagc

SEQ ID NO: 65005 - DNA, 70 bp, Artificial Sequence
  Synthetic
gccaagcatttaggtgacactataggcagagtgtgatgcagtacggtttcagagctatgctggaaacagc

SEQ ID NO: 65006 - DNA, 70 bp, Artificial Sequence
  Synthetic
gccaagcatttaggtgacactatagtcacggaggggcggctctgcgtttcagagctatgctggaaacagc

SEQ ID NO: 65007 - DNA, 70 bp, Artificial Sequence
  Synthetic
gccaagcatttaggtgacactatagtctgctagctgacagagcccgtttcagagctatgctggaaacagc

SEQ ID NO: 65008 - DNA, 70 bp, Artificial Sequence
  Synthetic
gccaagcatttaggtgacactataggaacgtgatgctgtatgtgagtttcagagctatgctggaaacagc

SEQ ID NO: 65009 - DNA, 70 bp, Artificial Sequence
  Synthetic
gccaagcatttaggtgacactatagggagcgtaagcagcggtgaggtttcagagctatgctggaaacagc

SEQ ID NO: 65010 - DNA, 70 bp, Artificial Sequence
  Synthetic
gccaagcatttaggtgacactatagacttacagaactggagaaaagtttcagagctatgctggaaacagc

SEQ ID NO: 65011 - DNA, 70 bp, Artificial Sequence
  Synthetic
gccaagcatttaggtgacactatagatcaccttcaagacatacaggtttcagagctatgctggaaacagc

SEQ ID NO: 65012 - DNA, 70 bp, Artificial Sequence
  Synthetic
gccaagcatttaggtgacactataggaggcccgcttggaggtccggtttcagagctatgctggaaacagc

SEQ ID NO: 65013 - DNA, 70 bp, Artificial Sequence
  Synthetic
gccaagcatttaggtgacactataggctgtggtccgtgcctctaggtttcagagctatgctggaaacagc

SEQ ID NO: 65014 - DNA, 70 bp, Artificial Sequence
  Synthetic
gccaagcatttaggtgacactatagttccctaactgggaggtgacgtttcagagctatgctggaaacagc

SEQ ID NO: 65015 - DNA, 70 bp, Artificial Sequence
  Synthetic
gccaagcatttaggtgacactatagtgctggtcagttgagtttctgtttcagagctatgctggaaacagc

SEQ ID NO: 65016 - DNA, 70 bp, Artificial Sequence
  Synthetic
gccaagcatttaggtgacactatagtaaccactcagtggctcacagtttcagagctatgctggaaacagc

SEQ ID NO: 65017 - DNA, 70 bp, Artificial Sequence
  Synthetic
gccaagcatttaggtgacactatagaagaagcctagcagggtctggtttcagagctatgctggaaacagc

SEQ ID NO: 65018 - DNA, 70 bp, Artificial Sequence
  Synthetic
gccaagcatttaggtgacactataggcagctttttctctcatctcgtttcagagctatgctggaaacagc

SEQ ID NO: 65019 - DNA, 70 bp, Artificial Sequence
  Synthetic
gccaagcatttaggtgacactatagtgtctaaaggacatgctagcgtttcagagctatgctggaaacagc

SEQ ID NO: 65020 - DNA, 70 bp, Artificial Sequence
  Synthetic
gccaagcatttaggtgacactatagagacacactactgctcctccgtttcagagctatgctggaaacagc

SEQ ID NO: 65021 - DNA, 70 bp, Artificial Sequence
  Synthetic
gccaagcatttaggtgacactatagccgacttggcccaagtagttgtttcagagctatgctggaaacagc

SEQ ID NO: 65022 - DNA, 70 bp, Artificial Sequence
  Synthetic
gccaagcatttaggtgacactataggtctctatcttcagtgcaaagtttcagagctatgctggaaacagc

SEQ ID NO: 65023 - DNA, 70 bp, Artificial Sequence
  Synthetic
gccaagcatttaggtgacactatagaaaaactctgggaaatgactgtttcagagctatgctggaaacagc

SEQ ID NO: 65024 - DNA, 70 bp, Artificial Sequence
  Synthetic
gccaagcatttaggtgacactatagagcgcggcccaggggtcatagtttcagagctatgctggaaacagc

SEQ ID NO: 65025 - DNA, 70 bp, Artificial Sequence
  Synthetic
gccaagcatttaggtgacactatagtagtttcagggctcccgcccgtttcagagctatgctggaaacagc

SEQ ID NO: 65026 - DNA, 70 bp, Artificial Sequence
  Synthetic
gccaagcatttaggtgacactatagctcttggaactgggataatagtttcagagctatgctggaaacagc

SEQ ID NO: 65027 - DNA, 70 bp, Artificial Sequence
  Synthetic
gccaagcatttaggtgacactatagggcgggggctgcgggctcaggtttcagagctatgctggaaacagc

SEQ ID NO: 65028 - DNA, 70 bp, Artificial Sequence
  Synthetic
gccaagcatttaggtgacactatagcgcgcgtcagtagccccagcgtttcagagctatgctggaaacagc

SEQ ID NO: 65029 - DNA, 70 bp, Artificial Sequence
  Synthetic
gccaagcatttaggtgacactataggcctcgggtgtgctcaggccgtttcagagctatgctggaaacagc

SEQ ID NO: 65030 - DNA, 70 bp, Artificial Sequence
  Synthetic
gccaagcatttaggtgacactatagaatcatggtgatttagctcagtttcagagctatgctggaaacagc

SEQ ID NO: 65031 - DNA, 70 bp, Artificial Sequence
  Synthetic
gccaagcatttaggtgacactatagagaaacagaatgaagaaggcgtttcagagctatgctggaaacagc

SEQ ID NO: 65032 - DNA, 70 bp, Artificial Sequence
  Synthetic
gccaagcatttaggtgacactataggggcctctgcagaacactaggtttcagagctatgctggaaacagc

SEQ ID NO: 65033 - DNA, 70 bp, Artificial Sequence
  Synthetic
gccaagcatttaggtgacactatagcgggagattggaacagaggcgtttcagagctatgctggaaacagc

SEQ ID NO: 65034 - DNA, 70 bp, Artificial Sequence
  Synthetic
gccaagcatttaggtgacactatagtccctgctgaggtttgccgcgtttcagagctatgctggaaacagc

SEQ ID NO: 65035 - DNA, 70 bp, Artificial Sequence
  Synthetic
gccaagcatttaggtgacactatagtggtggtggtggtggtgattgtttcagagctatgctggaaacagc

SEQ ID NO: 65036 - DNA, 70 bp, Artificial Sequence
  Synthetic
gccaagcatttaggtgacactatagaaacttgatgaaatagacgggtttcagagctatgctggaaacagc

SEQ ID NO: 65037 - DNA, 70 bp, Artificial Sequence
  Synthetic
gccaagcatttaggtgacactataggatgaaatacacagagggttgtttcagagctatgctggaaacagc

SEQ ID NO: 65038 - DNA, 70 bp, Artificial Sequence
  Synthetic
gccaagcatttaggtgacactatagaactggcatggtcattcatcgtttcagagctatgctggaaacagc

SEQ ID NO: 65039 - DNA, 70 bp, Artificial Sequence
  Synthetic
gccaagcatttaggtgacactataggatgacgggtccaagagaacgtttcagagctatgctggaaacagc

SEQ ID NO: 65040 - DNA, 70 bp, Artificial Sequence
  Synthetic
gccaagcatttaggtgacactatagcaaaaccttggttctcagcagtttcagagctatgctggaaacagc

SEQ ID NO: 65041 - DNA, 70 bp, Artificial Sequence
  Synthetic
gccaagcatttaggtgacactatagaacactcattctggaaagtggtttcagagctatgctggaaacagc

SEQ ID NO: 65042 - DNA, 70 bp, Artificial Sequence
  Synthetic
gccaagcatttaggtgacactatagtcagctaacattttccatcagtttcagagctatgctggaaacagc

SEQ ID NO: 65043 - DNA, 70 bp, Artificial Sequence
  Synthetic
gccaagcatttaggtgacactatagacattttctgagagcaggtagtttcagagctatgctggaaacagc

SEQ ID NO: 65044 - DNA, 70 bp, Artificial Sequence
  Synthetic
gccaagcatttaggtgacactatagcatgcacagagtacattcatgtttcagagctatgctggaaacagc

SEQ ID NO: 65045 - DNA, 70 bp, Artificial Sequence
  Synthetic
gccaagcatttaggtgacactatagctgtaaactgctccatcagcgtttcagagctatgctggaaacagc

SEQ ID NO: 65046 - DNA, 70 bp, Artificial Sequence
  Synthetic
gccaagcatttaggtgacactataggacatccagatcatgaaagagtttcagagctatgctggaaacagc

SEQ ID NO: 65047 - DNA, 70 bp, Artificial Sequence
  Synthetic
gccaagcatttaggtgacactatagagacgggggcatgctggctggtttcagagctatgctggaaacagc

SEQ ID NO: 65048 - DNA, 70 bp, Artificial Sequence
  Synthetic
gccaagcatttaggtgacactatagcaagccctcaaataatgcaagtttcagagctatgctggaaacagc

SEQ ID NO: 65049 - DNA, 70 bp, Artificial Sequence
  Synthetic
gccaagcatttaggtgacactataggctttaactcagcattttccgtttcagagctatgctggaaacagc

SEQ ID NO: 65050 - DNA, 70 bp, Artificial Sequence
  Synthetic
gccaagcatttaggtgacactatagagagttcagtttcttcacgagtttcagagctatgctggaaacagc

SEQ ID NO: 65051 - DNA, 70 bp, Artificial Sequence
  Synthetic
gccaagcatttaggtgacactatagcagatggcagtcactactgtgtttcagagctatgctggaaacagc

SEQ ID NO: 65052 - DNA, 70 bp, Artificial Sequence
  Synthetic
gccaagcatttaggtgacactataggatccaatttgtggatctgagtttcagagctatgctggaaacagc

SEQ ID NO: 65053 - DNA, 70 bp, Artificial Sequence
  Synthetic
gccaagcatttaggtgacactatagccggtgagacccaggctcaggtttcagagctatgctggaaacagc

SEQ ID NO: 65054 - DNA, 70 bp, Artificial Sequence
  Synthetic
gccaagcatttaggtgacactatagcttggcgacagggcggtcacgtttcagagctatgctggaaacagc

SEQ ID NO: 65055 - DNA, 70 bp, Artificial Sequence
  Synthetic
gccaagcatttaggtgacactataggcaacagcaacaactttttggtttcagagctatgctggaaacagc

SEQ ID NO: 65056 - DNA, 70 bp, Artificial Sequence
  Synthetic
gccaagcatttaggtgacactatagtggtttgtattttgcaacacgtttcagagctatgctggaaacagc

SEQ ID NO: 65057 - DNA, 70 bp, Artificial Sequence
  Synthetic
gccaagcatttaggtgacactatagcggagtactgcccttcagaggtttcagagctatgctggaaacagc

SEQ ID NO: 65058 - DNA, 70 bp, Artificial Sequence
  Synthetic
gccaagcatttaggtgacactatagtcacttgaagtcaagagtccgtttcagagctatgctggaaacagc

SEQ ID NO: 65059 - DNA, 70 bp, Artificial Sequence
  Synthetic
gccaagcatttaggtgacactatagcactattcaccgacacttaagtttcagagctatgctggaaacagc

SEQ ID NO: 65060 - DNA, 70 bp, Artificial Sequence
  Synthetic
gccaagcatttaggtgacactatagggccagtgtgctcatctgaggtttcagagctatgctggaaacagc

SEQ ID NO: 65061 - DNA, 70 bp, Artificial Sequence
  Synthetic
gccaagcatttaggtgacactataggcatctgtgaaagtctgagggtttcagagctatgctggaaacagc

SEQ ID NO: 65062 - DNA, 70 bp, Artificial Sequence
  Synthetic
gccaagcatttaggtgacactataggcctctacagaggagccctggtttcagagctatgctggaaacagc

SEQ ID NO: 65063 - DNA, 70 bp, Artificial Sequence
  Synthetic
gccaagcatttaggtgacactatagtttgttaggtaagtacactcgtttcagagctatgctggaaacagc

SEQ ID NO: 65064 - DNA, 70 bp, Artificial Sequence
  Synthetic
gccaagcatttaggtgacactatagaaggagggtcaggcctttctgtttcagagctatgctggaaacagc

SEQ ID NO: 65065 - DNA, 70 bp, Artificial Sequence
  Synthetic
gccaagcatttaggtgacactatagaggatgaggtcgggtacatagtttcagagctatgctggaaacagc

SEQ ID NO: 65066 - DNA, 70 bp, Artificial Sequence
  Synthetic
gccaagcatttaggtgacactatagaaacgggagaggtcatggtggtttcagagctatgctggaaacagc

SEQ ID NO: 65067 - DNA, 70 bp, Artificial Sequence
  Synthetic
gccaagcatttaggtgacactatagctgacgacgggggctacatcgtttcagagctatgctggaaacagc

SEQ ID NO: 65068 - DNA, 70 bp, Artificial Sequence
  Synthetic
gccaagcatttaggtgacactataggaaggggatgatgatgatgggtttcagagctatgctggaaacagc

SEQ ID NO: 65069 - DNA, 70 bp, Artificial Sequence
  Synthetic
gccaagcatttaggtgacactatagtactgcttccagagacagcagtttcagagctatgctggaaacagc

SEQ ID NO: 65070 - DNA, 70 bp, Artificial Sequence
  Synthetic
gccaagcatttaggtgacactatagaatgttcatccttgttagcagtttcagagctatgctggaaacagc

SEQ ID NO: 65071 - DNA, 70 bp, Artificial Sequence
  Synthetic
gccaagcatttaggtgacactatagtggtcttagacgcagttatcgtttcagagctatgctggaaacagc

SEQ ID NO: 65072 - DNA, 70 bp, Artificial Sequence
  Synthetic
gccaagcatttaggtgacactatagcaggatcttaggattgcttcgtttcagagctatgctggaaacagc

SEQ ID NO: 65073 - DNA, 70 bp, Artificial Sequence
  Synthetic
gccaagcatttaggtgacactatagagtttggcattccacgcaaagtttcagagctatgctggaaacagc

SEQ ID NO: 65074 - DNA, 70 bp, Artificial Sequence
  Synthetic
gccaagcatttaggtgacactatagcttagaactttcaggtgtgcgtttcagagctatgctggaaacagc

SEQ ID NO: 65075 - DNA, 70 bp, Artificial Sequence
  Synthetic
gccaagcatttaggtgacactatagattagatagtgcatcttctggtttcagagctatgctggaaacagc

SEQ ID NO: 65076 - DNA, 70 bp, Artificial Sequence
  Synthetic
gccaagcatttaggtgacactatagtatttattcttgctctgtgcgtttcagagctatgctggaaacagc

SEQ ID NO: 65077 - DNA, 70 bp, Artificial Sequence
  Synthetic
gccaagcatttaggtgacactataggaagaaaaccctgtgatatcgtttcagagctatgctggaaacagc

SEQ ID NO: 65078 - DNA, 70 bp, Artificial Sequence
  Synthetic
gccaagcatttaggtgacactatagagcctggcgcctcggcctaggtttcagagctatgctggaaacagc

SEQ ID NO: 65079 - DNA, 70 bp, Artificial Sequence
  Synthetic
gccaagcatttaggtgacactatagttctcacagtcagagcaaacgtttcagagctatgctggaaacagc

SEQ ID NO: 65080 - DNA, 70 bp, Artificial Sequence
  Synthetic
gccaagcatttaggtgacactatagacccaggctcccttgtgaacgtttcagagctatgctggaaacagc

SEQ ID NO: 65081 - DNA, 70 bp, Artificial Sequence
  Synthetic
gccaagcatttaggtgacactatagcccgattcctggaagtatgagtttcagagctatgctggaaacagc

SEQ ID NO: 65082 - DNA, 70 bp, Artificial Sequence
  Synthetic
gccaagcatttaggtgacactatagatttgtcatagaagtccacggtttcagagctatgctggaaacagc

SEQ ID NO: 65083 - DNA, 70 bp, Artificial Sequence
  Synthetic
gccaagcatttaggtgacactatagcataaagctgctggatgaaagtttcagagctatgctggaaacagc

SEQ ID NO: 65084 - DNA, 70 bp, Artificial Sequence
  Synthetic
gccaagcatttaggtgacactataggggagggaaactgagtcacggtttcagagctatgctggaaacagc

SEQ ID NO: 65085 - DNA, 70 bp, Artificial Sequence
  Synthetic
gccaagcatttaggtgacactatagcacgaggaggctgcgcggtggtttcagagctatgctggaaacagc

SEQ ID NO: 65086 - DNA, 70 bp, Artificial Sequence
  Synthetic
gccaagcatttaggtgacactatagatggaatgttccagttatgagtttcagagctatgctggaaacagc

SEQ ID NO: 65087 - DNA, 70 bp, Artificial Sequence
  Synthetic
gccaagcatttaggtgacactatagaagaccaagcagaagtaatggtttcagagctatgctggaaacagc

SEQ ID NO: 65088 - DNA, 70 bp, Artificial Sequence
  Synthetic
gccaagcatttaggtgacactatagtgaagctgttacttgctcttgtttcagagctatgctggaaacagc

SEQ ID NO: 65089 - DNA, 70 bp, Artificial Sequence
  Synthetic
gccaagcatttaggtgacactatagctgaagctgttacttgctctgtttcagagctatgctggaaacagc

SEQ ID NO: 65090 - DNA, 70 bp, Artificial Sequence
  Synthetic
gccaagcatttaggtgacactatagctagtgatgttacttgctctgtttcagagctatgctggaaacagc

SEQ ID NO: 65091 - DNA, 70 bp, Artificial Sequence
  Synthetic
gccaagcatttaggtgacactatagaagaccaagcagaagtaattgtttcagagctatgctggaaacagc

SEQ ID NO: 65092 - DNA, 70 bp, Artificial Sequence
  Synthetic
gccaagcatttaggtgacactatagctcctcctgcccaagatgtagtttcagagctatgctggaaacagc

SEQ ID NO: 65093 - DNA, 70 bp, Artificial Sequence
  Synthetic
gccaagcatttaggtgacactatagctttgatgctgtcaccttcagtttcagagctatgctggaaacagc

SEQ ID NO: 65094 - DNA, 70 bp, Artificial Sequence
  Synthetic
gccaagcatttaggtgacactataggtattggccgcagagaataagtttcagagctatgctggaaacagc

SEQ ID NO: 65095 - DNA, 70 bp, Artificial Sequence
  Synthetic
gccaagcatttaggtgacactatagcccacctccaaaaatcatgagtttcagagctatgctggaaacagc

SEQ ID NO: 65096 - DNA, 70 bp, Artificial Sequence
  Synthetic
gccaagcatttaggtgacactatagtggtttttcaaagttcctaggtttcagagctatgctggaaacagc

SEQ ID NO: 65097 - DNA, 70 bp, Artificial Sequence
  Synthetic
gccaagcatttaggtgacactatagaaggtcatacagacttttccgtttcagagctatgctggaaacagc

SEQ ID NO: 65098 - DNA, 70 bp, Artificial Sequence
  Synthetic
gccaagcatttaggtgacactatagttcgacacaaactgtcagaagtttcagagctatgctggaaacagc

SEQ ID NO: 65099 - DNA, 70 bp, Artificial Sequence
  Synthetic
gccaagcatttaggtgacactatagctgcaccccttgagtggctagtttcagagctatgctggaaacagc

SEQ ID NO: 65100 - DNA, 70 bp, Artificial Sequence
  Synthetic
gccaagcatttaggtgacactatagtccagtaatggacatactaggtttcagagctatgctggaaacagc

SEQ ID NO: 65101 - DNA, 70 bp, Artificial Sequence
  Synthetic
gccaagcatttaggtgacactatagattttttcaaaaccaggtgggtttcagagctatgctggaaacagc

SEQ ID NO: 65102 - DNA, 70 bp, Artificial Sequence
  Synthetic
gccaagcatttaggtgacactatagggtatgatggcgaacgtcacgtttcagagctatgctggaaacagc

SEQ ID NO: 65103 - DNA, 70 bp, Artificial Sequence
  Synthetic
gccaagcatttaggtgacactatagtgtggtatcacagggctcacgtttcagagctatgctggaaacagc

SEQ ID NO: 65104 - DNA, 70 bp, Artificial Sequence
  Synthetic
gccaagcatttaggtgacactatagactgggaagtcagtcaggtcgtttcagagctatgctggaaacagc

SEQ ID NO: 65105 - DNA, 70 bp, Artificial Sequence
  Synthetic
gccaagcatttaggtgacactataggcccatcaggcttggctcacgtttcagagctatgctggaaacagc

SEQ ID NO: 65106 - DNA, 70 bp, Artificial Sequence
  Synthetic
gccaagcatttaggtgacactatagtgcttattagttgccaaagtgtttcagagctatgctggaaacagc

SEQ ID NO: 65107 - DNA, 70 bp, Artificial Sequence
  Synthetic
gccaagcatttaggtgacactatagctcagttcacgaaaagcgaggtttcagagctatgctggaaacagc

SEQ ID NO: 65108 - DNA, 70 bp, Artificial Sequence
  Synthetic
gccaagcatttaggtgacactatagccacctgggctgagcctagtgtttcagagctatgctggaaacagc

SEQ ID NO: 65109 - DNA, 70 bp, Artificial Sequence
  Synthetic
gccaagcatttaggtgacactatagcttccccaaaaagaagtagcgtttcagagctatgctggaaacagc

SEQ ID NO: 65110 - DNA, 70 bp, Artificial Sequence
  Synthetic
gccaagcatttaggtgacactataggaacttcacagtccagaccagtttcagagctatgctggaaacagc

SEQ ID NO: 65111 - DNA, 70 bp, Artificial Sequence
  Synthetic
gccaagcatttaggtgacactataggagaagcggttcagccttttgtttcagagctatgctggaaacagc

SEQ ID NO: 65112 - DNA, 70 bp, Artificial Sequence
  Synthetic
gccaagcatttaggtgacactataggttgtgctccgcagcaaagagtttcagagctatgctggaaacagc

SEQ ID NO: 65113 - DNA, 70 bp, Artificial Sequence
  Synthetic
gccaagcatttaggtgacactatagattgacagcccccttctcaagtttcagagctatgctggaaacagc

SEQ ID NO: 65114 - DNA, 70 bp, Artificial Sequence
  Synthetic
gccaagcatttaggtgacactatagatcgcagggccagcgggcgcgtttcagagctatgctggaaacagc

SEQ ID NO: 65115 - DNA, 70 bp, Artificial Sequence
  Synthetic
gccaagcatttaggtgacactatagcccggcctggatgtctactcgtttcagagctatgctggaaacagc

SEQ ID NO: 65116 - DNA, 70 bp, Artificial Sequence
  Synthetic
gccaagcatttaggtgacactatagcccgggactctgcctagagcgtttcagagctatgctggaaacagc

SEQ ID NO: 65117 - DNA, 70 bp, Artificial Sequence
  Synthetic
gccaagcatttaggtgacactatagccttctcatggtcacacaatgtttcagagctatgctggaaacagc

SEQ ID NO: 65118 - DNA, 70 bp, Artificial Sequence
  Synthetic
gccaagcatttaggtgacactatagtgtggacccagaggattttagtttcagagctatgctggaaacagc

SEQ ID NO: 65119 - DNA, 70 bp, Artificial Sequence
  Synthetic
gccaagcatttaggtgacactatagttcatacgtcgtctcgtcaagtttcagagctatgctggaaacagc

SEQ ID NO: 65120 - DNA, 70 bp, Artificial Sequence
  Synthetic
gccaagcatttaggtgacactatagctcgtctcatcatagagctcgtttcagagctatgctggaaacagc

SEQ ID NO: 65121 - DNA, 70 bp, Artificial Sequence
  Synthetic
gccaagcatttaggtgacactatagcttcatgccccagcacatcagtttcagagctatgctggaaacagc

SEQ ID NO: 65122 - DNA, 70 bp, Artificial Sequence
  Synthetic
gccaagcatttaggtgacactataggggatccccgactctactgagtttcagagctatgctggaaacagc

SEQ ID NO: 65123 - DNA, 70 bp, Artificial Sequence
  Synthetic
gccaagcatttaggtgacactatagtttattagcttgtcttccgggtttcagagctatgctggaaacagc

SEQ ID NO: 65124 - DNA, 70 bp, Artificial Sequence
  Synthetic
gccaagcatttaggtgacactataggaagggccaagaagctgaaggtttcagagctatgctggaaacagc

SEQ ID NO: 65125 - DNA, 70 bp, Artificial Sequence
  Synthetic
gccaagcatttaggtgacactatagtggaagacagtctgcttaacgtttcagagctatgctggaaacagc

SEQ ID NO: 65126 - DNA, 70 bp, Artificial Sequence
  Synthetic
gccaagcatttaggtgacactatagaagctcttaggggaaaaatggtttcagagctatgctggaaacagc

SEQ ID NO: 65127 - DNA, 70 bp, Artificial Sequence
  Synthetic
gccaagcatttaggtgacactatagcctcgagcccttctcagtaggtttcagagctatgctggaaacagc

SEQ ID NO: 65128 - DNA, 70 bp, Artificial Sequence
  Synthetic
gccaagcatttaggtgacactatagctgcgcaagttgtttcatctgtttcagagctatgctggaaacagc

SEQ ID NO: 65129 - DNA, 70 bp, Artificial Sequence
  Synthetic
gccaagcatttaggtgacactataggtgggcaaaagtggtcacaagtttcagagctatgctggaaacagc

SEQ ID NO: 65130 - DNA, 70 bp, Artificial Sequence
  Synthetic
gccaagcatttaggtgacactatagccgaggattatgaagcctgcgtttcagagctatgctggaaacagc

SEQ ID NO: 65131 - DNA, 70 bp, Artificial Sequence
  Synthetic
gccaagcatttaggtgacactatagctgtgggcaggccgattagcgtttcagagctatgctggaaacagc

SEQ ID NO: 65132 - DNA, 70 bp, Artificial Sequence
  Synthetic
gccaagcatttaggtgacactatagatactcataacacccgaatggtttcagagctatgctggaaacagc

SEQ ID NO: 65133 - DNA, 70 bp, Artificial Sequence
  Synthetic
gccaagcatttaggtgacactatagctgggcccgcctgtgcctaggtttcagagctatgctggaaacagc

SEQ ID NO: 65134 - DNA, 70 bp, Artificial Sequence
  Synthetic
gccaagcatttaggtgacactatagcgcaaggccaagacgtgagtgtttcagagctatgctggaaacagc

SEQ ID NO: 65135 - DNA, 70 bp, Artificial Sequence
  Synthetic
gccaagcatttaggtgacactatagcggggtgaggggcttctagagtttcagagctatgctggaaacagc

SEQ ID NO: 65136 - DNA, 70 bp, Artificial Sequence
  Synthetic
gccaagcatttaggtgacactataggatactcttcaaatttccgggtttcagagctatgctggaaacagc

SEQ ID NO: 65137 - DNA, 70 bp, Artificial Sequence
  Synthetic
gccaagcatttaggtgacactataggttctcatctcattcaggccgtttcagagctatgctggaaacagc

SEQ ID NO: 65138 - DNA, 70 bp, Artificial Sequence
  Synthetic
gccaagcatttaggtgacactatagaataagggctttccgagattgtttcagagctatgctggaaacagc

SEQ ID NO: 65139 - DNA, 70 bp, Artificial Sequence
  Synthetic
gccaagcatttaggtgacactatagttgtctcttacccgaagcatgtttcagagctatgctggaaacagc

SEQ ID NO: 65140 - DNA, 70 bp, Artificial Sequence
  Synthetic
gccaagcatttaggtgacactatagccggggacacggggtctagcgtttcagagctatgctggaaacagc

SEQ ID NO: 65141 - DNA, 70 bp, Artificial Sequence
  Synthetic
gccaagcatttaggtgacactatagggctgagcctggtggtcagggtttcagagctatgctggaaacagc

SEQ ID NO: 65142 - DNA, 70 bp, Artificial Sequence
  Synthetic
gccaagcatttaggtgacactatagtaccaaaacagaagcagtatgtttcagagctatgctggaaacagc

SEQ ID NO: 65143 - DNA, 70 bp, Artificial Sequence
  Synthetic
gccaagcatttaggtgacactatagtctttgctcacacttgaatcgtttcagagctatgctggaaacagc

SEQ ID NO: 65144 - DNA, 70 bp, Artificial Sequence
  Synthetic
gccaagcatttaggtgacactatagccaaagtctcagttactttcgtttcagagctatgctggaaacagc

SEQ ID NO: 65145 - DNA, 70 bp, Artificial Sequence
  Synthetic
gccaagcatttaggtgacactataggcgggcggatcattcactctgtttcagagctatgctggaaacagc

SEQ ID NO: 65146 - DNA, 70 bp, Artificial Sequence
  Synthetic
gccaagcatttaggtgacactatagcttcatgggaagcaagcagagtttcagagctatgctggaaacagc

SEQ ID NO: 65147 - DNA, 70 bp, Artificial Sequence
  Synthetic
gccaagcatttaggtgacactatagattgtgcatgacttgtctgtgtttcagagctatgctggaaacagc

SEQ ID NO: 65148 - DNA, 70 bp, Artificial Sequence
  Synthetic
gccaagcatttaggtgacactatagacaagtcttgtactgtctgagtttcagagctatgctggaaacagc

SEQ ID NO: 65149 - DNA, 70 bp, Artificial Sequence
  Synthetic
gccaagcatttaggtgacactatagcatcccccatcagtacatcggtttcagagctatgctggaaacagc

SEQ ID NO: 65150 - DNA, 70 bp, Artificial Sequence
  Synthetic
gccaagcatttaggtgacactatagttcacagtgagggagtgctagtttcagagctatgctggaaacagc

SEQ ID NO: 65151 - DNA, 70 bp, Artificial Sequence
  Synthetic
gccaagcatttaggtgacactatagttcacagtaagggagtgctagtttcagagctatgctggaaacagc

SEQ ID NO: 65152 - DNA, 70 bp, Artificial Sequence
  Synthetic
gccaagcatttaggtgacactatagggcccatcctgcaggtcacagtttcagagctatgctggaaacagc

SEQ ID NO: 65153 - DNA, 70 bp, Artificial Sequence
  Synthetic
gccaagcatttaggtgacactataggggtcaacatggattagaaggtttcagagctatgctggaaacagc

SEQ ID NO: 65154 - DNA, 70 bp, Artificial Sequence
  Synthetic
gccaagcatttaggtgacactatagagacgggatactgctcagcagtttcagagctatgctggaaacagc

SEQ ID NO: 65155 - DNA, 70 bp, Artificial Sequence
  Synthetic
gccaagcatttaggtgacactataggagtcccatcattgttgcccgtttcagagctatgctggaaacagc

SEQ ID NO: 65156 - DNA, 70 bp, Artificial Sequence
  Synthetic
gccaagcatttaggtgacactatagtcgctacaggaagcactagggtttcagagctatgctggaaacagc

SEQ ID NO: 65157 - DNA, 70 bp, Artificial Sequence
  Synthetic
gccaagcatttaggtgacactataggggctcagctcacatcattcgtttcagagctatgctggaaacagc

SEQ ID NO: 65158 - DNA, 70 bp, Artificial Sequence
  Synthetic
gccaagcatttaggtgacactatagtgggtcacgtgaggactcaggtttcagagctatgctggaaacagc

SEQ ID NO: 65159 - DNA, 70 bp, Artificial Sequence
  Synthetic
gccaagcatttaggtgacactatagagcaacagcagcacagtaaagtttcagagctatgctggaaacagc

SEQ ID NO: 65160 - DNA, 70 bp, Artificial Sequence
  Synthetic
gccaagcatttaggtgacactataggagggaagtaaaaaagggaagtttcagagctatgctggaaacagc

SEQ ID NO: 65161 - DNA, 70 bp, Artificial Sequence
  Synthetic
gccaagcatttaggtgacactatagaagcctaacttctggttcctgtttcagagctatgctggaaacagc

SEQ ID NO: 65162 - DNA, 70 bp, Artificial Sequence
  Synthetic
gccaagcatttaggtgacactatagagtcgtgggaggaggaagtcgtttcagagctatgctggaaacagc

SEQ ID NO: 65163 - DNA, 70 bp, Artificial Sequence
  Synthetic
gccaagcatttaggtgacactatagtacgtgatgggaactgtacagtttcagagctatgctggaaacagc

SEQ ID NO: 65164 - DNA, 70 bp, Artificial Sequence
  Synthetic
gccaagcatttaggtgacactatagggcaacatgaaaggcatgatgtttcagagctatgctggaaacagc

SEQ ID NO: 65165 - DNA, 70 bp, Artificial Sequence
  Synthetic
gccaagcatttaggtgacactatagtttggattcaggagctaaccgtttcagagctatgctggaaacagc

SEQ ID NO: 65166 - DNA, 70 bp, Artificial Sequence
  Synthetic
gccaagcatttaggtgacactatagagaaaggtggaaaaggtggcgtttcagagctatgctggaaacagc

SEQ ID NO: 65167 - DNA, 70 bp, Artificial Sequence
  Synthetic
gccaagcatttaggtgacactatagtgtagtctctgctattcagggtttcagagctatgctggaaacagc

SEQ ID NO: 65168 - DNA, 70 bp, Artificial Sequence
  Synthetic
gccaagcatttaggtgacactatagtaccatggaaactgagtgaagtttcagagctatgctggaaacagc

SEQ ID NO: 65169 - DNA, 70 bp, Artificial Sequence
  Synthetic
gccaagcatttaggtgacactatagggggcttaggagttaagccagtttcagagctatgctggaaacagc

SEQ ID NO: 65170 - DNA, 70 bp, Artificial Sequence
  Synthetic
gccaagcatttaggtgacactataggaggctccagggcttcagctgtttcagagctatgctggaaacagc

SEQ ID NO: 65171 - DNA, 70 bp, Artificial Sequence
  Synthetic
gccaagcatttaggtgacactataggcgaatgccttcggcatcctgtttcagagctatgctggaaacagc

SEQ ID NO: 65172 - DNA, 70 bp, Artificial Sequence
  Synthetic
gccaagcatttaggtgacactatagggagccacagccgggcctaggtttcagagctatgctggaaacagc

SEQ ID NO: 65173 - DNA, 70 bp, Artificial Sequence
  Synthetic
gccaagcatttaggtgacactataggccctcatgaaggcttaacggtttcagagctatgctggaaacagc

SEQ ID NO: 65174 - DNA, 70 bp, Artificial Sequence
  Synthetic
gccaagcatttaggtgacactataggctggctaaaattgcctgaggtttcagagctatgctggaaacagc

SEQ ID NO: 65175 - DNA, 70 bp, Artificial Sequence
  Synthetic
gccaagcatttaggtgacactatagaccatcatgtcaggtgttacgtttcagagctatgctggaaacagc

SEQ ID NO: 65176 - DNA, 70 bp, Artificial Sequence
  Synthetic
gccaagcatttaggtgacactatagctccttcagtatggtgctaggtttcagagctatgctggaaacagc

SEQ ID NO: 65177 - DNA, 70 bp, Artificial Sequence
  Synthetic
gccaagcatttaggtgacactataggacccagcgtcgggagcaaagtttcagagctatgctggaaacagc

SEQ ID NO: 65178 - DNA, 70 bp, Artificial Sequence
  Synthetic
gccaagcatttaggtgacactataggaaacagactgataagaagcgtttcagagctatgctggaaacagc

SEQ ID NO: 65179 - DNA, 70 bp, Artificial Sequence
  Synthetic
gccaagcatttaggtgacactatagcgagttcagtcagtagcagagtttcagagctatgctggaaacagc

SEQ ID NO: 65180 - DNA, 70 bp, Artificial Sequence
  Synthetic
gccaagcatttaggtgacactatagagtgtccccacagtcttagggtttcagagctatgctggaaacagc

SEQ ID NO: 65181 - DNA, 70 bp, Artificial Sequence
  Synthetic
gccaagcatttaggtgacactatagccatgagacaccgctcctccgtttcagagctatgctggaaacagc

SEQ ID NO: 65182 - DNA, 70 bp, Artificial Sequence
  Synthetic
gccaagcatttaggtgacactatagcggagcagctctgagagcgggtttcagagctatgctggaaacagc

SEQ ID NO: 65183 - DNA, 70 bp, Artificial Sequence
  Synthetic
gccaagcatttaggtgacactatagccccgctctcagagctgctcgtttcagagctatgctggaaacagc

SEQ ID NO: 65184 - DNA, 70 bp, Artificial Sequence
  Synthetic
gccaagcatttaggtgacactataggggcacttagcgcctcgtgcgtttcagagctatgctggaaacagc

SEQ ID NO: 65185 - DNA, 70 bp, Artificial Sequence
  Synthetic
gccaagcatttaggtgacactataggactgggggctacgccagctgtttcagagctatgctggaaacagc

SEQ ID NO: 65186 - DNA, 70 bp, Artificial Sequence
  Synthetic
gccaagcatttaggtgacactatagaaagaaatcaacatcgtctggtttcagagctatgctggaaacagc

SEQ ID NO: 65187 - DNA, 70 bp, Artificial Sequence
  Synthetic
gccaagcatttaggtgacactatagttgaccagaattggatacaggtttcagagctatgctggaaacagc

SEQ ID NO: 65188 - DNA, 70 bp, Artificial Sequence
  Synthetic
gccaagcatttaggtgacactataggagagcgagatctgctatgagtttcagagctatgctggaaacagc

SEQ ID NO: 65189 - DNA, 70 bp, Artificial Sequence
  Synthetic
gccaagcatttaggtgacactataggaatggcttctgctacgccggtttcagagctatgctggaaacagc

SEQ ID NO: 65190 - DNA, 70 bp, Artificial Sequence
  Synthetic
gccaagcatttaggtgacactatagaccatggtttatactatcaggtttcagagctatgctggaaacagc

SEQ ID NO: 65191 - DNA, 70 bp, Artificial Sequence
  Synthetic
gccaagcatttaggtgacactatagtgtagtaagcagaactgtacgtttcagagctatgctggaaacagc

SEQ ID NO: 65192 - DNA, 70 bp, Artificial Sequence
  Synthetic
gccaagcatttaggtgacactatagtgatcatcatgaagaagacagtttcagagctatgctggaaacagc

SEQ ID NO: 65193 - DNA, 70 bp, Artificial Sequence
  Synthetic
gccaagcatttaggtgacactatagatgacgataacttcgagatcgtttcagagctatgctggaaacagc

SEQ ID NO: 65194 - DNA, 70 bp, Artificial Sequence
  Synthetic
gccaagcatttaggtgacactataggtctcctgaagaggaaggaggtttcagagctatgctggaaacagc

SEQ ID NO: 65195 - DNA, 70 bp, Artificial Sequence
  Synthetic
gccaagcatttaggtgacactataggtcgatctaggtcaaatgaagtttcagagctatgctggaaacagc

SEQ ID NO: 65196 - DNA, 70 bp, Artificial Sequence
  Synthetic
gccaagcatttaggtgacactataggtcccactcaaggtcctaacgtttcagagctatgctggaaacagc

SEQ ID NO: 65197 - DNA, 70 bp, Artificial Sequence
  Synthetic
gccaagcatttaggtgacactatagaggtccagatcagttgacaggtttcagagctatgctggaaacagc

SEQ ID NO: 65198 - DNA, 70 bp, Artificial Sequence
  Synthetic
gccaagcatttaggtgacactatagaggagttctgagttaatctcgtttcagagctatgctggaaacagc

SEQ ID NO: 65199 - DNA, 70 bp, Artificial Sequence
  Synthetic
gccaagcatttaggtgacactatagaagtgcaagtcctgaaagaagtttcagagctatgctggaaacagc

SEQ ID NO: 65200 - DNA, 70 bp, Artificial Sequence
  Synthetic
gccaagcatttaggtgacactatagcccaagtctcctgaagaggagtttcagagctatgctggaaacagc

SEQ ID NO: 65201 - DNA, 70 bp, Artificial Sequence
  Synthetic
gccaagcatttaggtgacactatagttcccatcacctgtctcagtgtttcagagctatgctggaaacagc

SEQ ID NO: 65202 - DNA, 70 bp, Artificial Sequence
  Synthetic
gccaagcatttaggtgacactatagatctaagtgaagatatgcaggtttcagagctatgctggaaacagc

SEQ ID NO: 65203 - DNA, 70 bp, Artificial Sequence
  Synthetic
gccaagcatttaggtgacactatagcagccactggacaaagctgtgtttcagagctatgctggaaacagc

SEQ ID NO: 65204 - DNA, 70 bp, Artificial Sequence
  Synthetic
gccaagcatttaggtgacactatagtgtaagtactttttcactgcgtttcagagctatgctggaaacagc

SEQ ID NO: 65205 - DNA, 70 bp, Artificial Sequence
  Synthetic
gccaagcatttaggtgacactatagatggaaattaccagcagtaagtttcagagctatgctggaaacagc

SEQ ID NO: 65206 - DNA, 70 bp, Artificial Sequence
  Synthetic
gccaagcatttaggtgacactatagattgcttttgaagtgctggtgtttcagagctatgctggaaacagc

SEQ ID NO: 65207 - DNA, 70 bp, Artificial Sequence
  Synthetic
gccaagcatttaggtgacactatagcagaaaacagaaaatggtgcgtttcagagctatgctggaaacagc

SEQ ID NO: 65208 - DNA, 70 bp, Artificial Sequence
  Synthetic
gccaagcatttaggtgacactatagacgaaagagaaggagtagaagtttcagagctatgctggaaacagc

SEQ ID NO: 65209 - DNA, 70 bp, Artificial Sequence
  Synthetic
gccaagcatttaggtgacactatagcacacgctcattgtcatgctgtttcagagctatgctggaaacagc

SEQ ID NO: 65210 - DNA, 70 bp, Artificial Sequence
  Synthetic
gccaagcatttaggtgacactatagcacacactcatcgtcatgctgtttcagagctatgctggaaacagc

SEQ ID NO: 65211 - DNA, 70 bp, Artificial Sequence
  Synthetic
gccaagcatttaggtgacactatagatgaccatgagcgtgtgatggtttcagagctatgctggaaacagc

SEQ ID NO: 65212 - DNA, 70 bp, Artificial Sequence
  Synthetic
gccaagcatttaggtgacactatagcagagcgggctgggtcatgagtttcagagctatgctggaaacagc

SEQ ID NO: 65213 - DNA, 70 bp, Artificial Sequence
  Synthetic
gccaagcatttaggtgacactatagagggtcacacgtctcccctcgtttcagagctatgctggaaacagc

SEQ ID NO: 65214 - DNA, 70 bp, Artificial Sequence
  Synthetic
gccaagcatttaggtgacactataggggggcgctatgggctaggggtttcagagctatgctggaaacagc

SEQ ID NO: 65215 - DNA, 70 bp, Artificial Sequence
  Synthetic
gccaagcatttaggtgacactataggtgggtaaaatgctgtcttcgtttcagagctatgctggaaacagc

SEQ ID NO: 65216 - DNA, 70 bp, Artificial Sequence
  Synthetic
gccaagcatttaggtgacactatagatcagacgggaaattgtaaggtttcagagctatgctggaaacagc

SEQ ID NO: 65217 - DNA, 70 bp, Artificial Sequence
  Synthetic
gccaagcatttaggtgacactataggaagatacttgctgttgagcgtttcagagctatgctggaaacagc

SEQ ID NO: 65218 - DNA, 70 bp, Artificial Sequence
  Synthetic
gccaagcatttaggtgacactatagcagcttttgctcatccacgagtttcagagctatgctggaaacagc

SEQ ID NO: 65219 - DNA, 70 bp, Artificial Sequence
  Synthetic
gccaagcatttaggtgacactataggacctgagggttctttcacagtttcagagctatgctggaaacagc

SEQ ID NO: 65220 - DNA, 70 bp, Artificial Sequence
  Synthetic
gccaagcatttaggtgacactatagctattggtggaagaatgaacgtttcagagctatgctggaaacagc

SEQ ID NO: 65221 - DNA, 70 bp, Artificial Sequence
  Synthetic
gccaagcatttaggtgacactatagtgtgtaggctcagaatcacagtttcagagctatgctggaaacagc

SEQ ID NO: 65222 - DNA, 70 bp, Artificial Sequence
  Synthetic
gccaagcatttaggtgacactatagtgacagtggagaggagggcggtttcagagctatgctggaaacagc

SEQ ID NO: 65223 - DNA, 70 bp, Artificial Sequence
  Synthetic
gccaagcatttaggtgacactatagaatgaaaagagacagtcaaggtttcagagctatgctggaaacagc

SEQ ID NO: 65224 - DNA, 70 bp, Artificial Sequence
  Synthetic
gccaagcatttaggtgacactatagccagaaaagtagcggcggcagtttcagagctatgctggaaacagc

SEQ ID NO: 65225 - DNA, 70 bp, Artificial Sequence
  Synthetic
gccaagcatttaggtgacactatagaatgttagatcttttgctgggtttcagagctatgctggaaacagc

SEQ ID NO: 65226 - DNA, 70 bp, Artificial Sequence
  Synthetic
gccaagcatttaggtgacactatagagtgcagctcctgccagggtgtttcagagctatgctggaaacagc

SEQ ID NO: 65227 - DNA, 70 bp, Artificial Sequence
  Synthetic
gccaagcatttaggtgacactatagcgggcacagaagagatcagtgtttcagagctatgctggaaacagc

SEQ ID NO: 65228 - DNA, 70 bp, Artificial Sequence
  Synthetic
gccaagcatttaggtgacactatagagtgtcatatttcctcttgcgtttcagagctatgctggaaacagc

SEQ ID NO: 65229 - DNA, 70 bp, Artificial Sequence
  Synthetic
gccaagcatttaggtgacactatagtgaagctgacatggtctattgtttcagagctatgctggaaacagc

SEQ ID NO: 65230 - DNA, 70 bp, Artificial Sequence
  Synthetic
gccaagcatttaggtgacactatagagagccacatccaggcctgagtttcagagctatgctggaaacagc

SEQ ID NO: 65231 - DNA, 70 bp, Artificial Sequence
  Synthetic
gccaagcatttaggtgacactatagcttcctccgtttctactcatgtttcagagctatgctggaaacagc

SEQ ID NO: 65232 - DNA, 70 bp, Artificial Sequence
  Synthetic
gccaagcatttaggtgacactatagcttagtgctgtagctgctgcgtttcagagctatgctggaaacagc

SEQ ID NO: 65233 - DNA, 70 bp, Artificial Sequence
  Synthetic
gccaagcatttaggtgacactatagctggctgcaagaatttcttcgtttcagagctatgctggaaacagc

SEQ ID NO: 65234 - DNA, 70 bp, Artificial Sequence
  Synthetic
gccaagcatttaggtgacactataggggctcagagcgtcgtgatcgtttcagagctatgctggaaacagc

SEQ ID NO: 65235 - DNA, 70 bp, Artificial Sequence
  Synthetic
gccaagcatttaggtgacactatagcccccaagcagttcagatacgtttcagagctatgctggaaacagc

SEQ ID NO: 65236 - DNA, 70 bp, Artificial Sequence
  Synthetic
gccaagcatttaggtgacactatagggctttccccaggcccctacgtttcagagctatgctggaaacagc

SEQ ID NO: 65237 - DNA, 70 bp, Artificial Sequence
  Synthetic
gccaagcatttaggtgacactatagtaggggaagggctcctcagagtttcagagctatgctggaaacagc

SEQ ID NO: 65238 - DNA, 70 bp, Artificial Sequence
  Synthetic
gccaagcatttaggtgacactatagcctgcactctcacagcttgcgtttcagagctatgctggaaacagc

SEQ ID NO: 65239 - DNA, 70 bp, Artificial Sequence
  Synthetic
gccaagcatttaggtgacactatagctgggctcagtagaagcagagtttcagagctatgctggaaacagc

SEQ ID NO: 65240 - DNA, 70 bp, Artificial Sequence
  Synthetic
gccaagcatttaggtgacactatagagccatgctatgtcacacgagtttcagagctatgctggaaacagc

SEQ ID NO: 65241 - DNA, 70 bp, Artificial Sequence
  Synthetic
gccaagcatttaggtgacactatagtgaagagatcagtgaccctggtttcagagctatgctggaaacagc

SEQ ID NO: 65242 - DNA, 70 bp, Artificial Sequence
  Synthetic
gccaagcatttaggtgacactatagactgcgtgagagaaaacagcgtttcagagctatgctggaaacagc

SEQ ID NO: 65243 - DNA, 70 bp, Artificial Sequence
  Synthetic
gccaagcatttaggtgacactatagatgagaatttgtgtagctcagtttcagagctatgctggaaacagc

SEQ ID NO: 65244 - DNA, 70 bp, Artificial Sequence
  Synthetic
gccaagcatttaggtgacactatagagttactcatcatcttcctcgtttcagagctatgctggaaacagc

SEQ ID NO: 65245 - DNA, 70 bp, Artificial Sequence
  Synthetic
gccaagcatttaggtgacactataggcgtgagagaaagcagctgggtttcagagctatgctggaaacagc

SEQ ID NO: 65246 - DNA, 70 bp, Artificial Sequence
  Synthetic
gccaagcatttaggtgacactataggggcatgtgtcatatccccggtttcagagctatgctggaaacagc

SEQ ID NO: 65247 - DNA, 70 bp, Artificial Sequence
  Synthetic
gccaagcatttaggtgacactatagagttactcgtcatcttcctggtttcagagctatgctggaaacagc

SEQ ID NO: 65248 - DNA, 70 bp, Artificial Sequence
  Synthetic
gccaagcatttaggtgacactatagagttactcgtcgtcttcttcgtttcagagctatgctggaaacagc

SEQ ID NO: 65249 - DNA, 70 bp, Artificial Sequence
  Synthetic
gccaagcatttaggtgacactatagttacgcttgacctccaaattgtttcagagctatgctggaaacagc

SEQ ID NO: 65250 - DNA, 70 bp, Artificial Sequence
  Synthetic
gccaagcatttaggtgacactatagaagagaacactggggtataggtttcagagctatgctggaaacagc

SEQ ID NO: 65251 - DNA, 70 bp, Artificial Sequence
  Synthetic
gccaagcatttaggtgacactatagaacactggtgatcagttaccgtttcagagctatgctggaaacagc

SEQ ID NO: 65252 - DNA, 70 bp, Artificial Sequence
  Synthetic
gccaagcatttaggtgacactatagcagcgctgtgatcctacacagtttcagagctatgctggaaacagc

SEQ ID NO: 65253 - DNA, 70 bp, Artificial Sequence
  Synthetic
gccaagcatttaggtgacactataggaatgcatttcctcactcatgtttcagagctatgctggaaacagc

SEQ ID NO: 65254 - DNA, 70 bp, Artificial Sequence
  Synthetic
gccaagcatttaggtgacactatagaagagtcagaaaaattaggcgtttcagagctatgctggaaacagc

SEQ ID NO: 65255 - DNA, 70 bp, Artificial Sequence
  Synthetic
gccaagcatttaggtgacactatagctgttgacgagtcttcgtaagtttcagagctatgctggaaacagc

SEQ ID NO: 65256 - DNA, 70 bp, Artificial Sequence
  Synthetic
gccaagcatttaggtgacactatagataaaatccggatcttcaaggtttcagagctatgctggaaacagc

SEQ ID NO: 65257 - DNA, 70 bp, Artificial Sequence
  Synthetic
gccaagcatttaggtgacactataggtctaccggggcaactgagcgtttcagagctatgctggaaacagc

SEQ ID NO: 65258 - DNA, 70 bp, Artificial Sequence
  Synthetic
gccaagcatttaggtgacactatagacgactatgacattgtggtggtttcagagctatgctggaaacagc

SEQ ID NO: 65259 - DNA, 70 bp, Artificial Sequence
  Synthetic
gccaagcatttaggtgacactatagctaagcagtggcatctgagtgtttcagagctatgctggaaacagc

SEQ ID NO: 65260 - DNA, 70 bp, Artificial Sequence
  Synthetic
gccaagcatttaggtgacactatagctgcctgatgggccctctaggtttcagagctatgctggaaacagc

SEQ ID NO: 65261 - DNA, 70 bp, Artificial Sequence
  Synthetic
gccaagcatttaggtgacactataggaaagagtttctgcggaagcgtttcagagctatgctggaaacagc

SEQ ID NO: 65262 - DNA, 70 bp, Artificial Sequence
  Synthetic
gccaagcatttaggtgacactatagaacctcacgtccttctgaccgtttcagagctatgctggaaacagc

SEQ ID NO: 65263 - DNA, 70 bp, Artificial Sequence
  Synthetic
gccaagcatttaggtgacactataggcatggcctcatctcagaccgtttcagagctatgctggaaacagc

SEQ ID NO: 65264 - DNA, 70 bp, Artificial Sequence
  Synthetic
gccaagcatttaggtgacactataggtggtgaaagatctcagtgggtttcagagctatgctggaaacagc

SEQ ID NO: 65265 - DNA, 70 bp, Artificial Sequence
  Synthetic
gccaagcatttaggtgacactatagcttgagtcaagttgattacggtttcagagctatgctggaaacagc

SEQ ID NO: 65266 - DNA, 70 bp, Artificial Sequence
  Synthetic
gccaagcatttaggtgacactatagaggaggcttaattcttcttggtttcagagctatgctggaaacagc

SEQ ID NO: 65267 - DNA, 70 bp, Artificial Sequence
  Synthetic
gccaagcatttaggtgacactatagagcctgtgcttagcagtgaagtttcagagctatgctggaaacagc

SEQ ID NO: 65268 - DNA, 70 bp, Artificial Sequence
  Synthetic
gccaagcatttaggtgacactatagagaaaccctttttaagagtggtttcagagctatgctggaaacagc

SEQ ID NO: 65269 - DNA, 70 bp, Artificial Sequence
  Synthetic
gccaagcatttaggtgacactataggctcactgcaagctctgatagtttcagagctatgctggaaacagc

SEQ ID NO: 65270 - DNA, 70 bp, Artificial Sequence
  Synthetic
gccaagcatttaggtgacactataggccaaagccaagaactgaccgtttcagagctatgctggaaacagc

SEQ ID NO: 65271 - DNA, 70 bp, Artificial Sequence
  Synthetic
gccaagcatttaggtgacactatagcagtgcattggggtcagcgcgtttcagagctatgctggaaacagc

SEQ ID NO: 65272 - DNA, 70 bp, Artificial Sequence
  Synthetic
gccaagcatttaggtgacactatagaagctcacttccttccataagtttcagagctatgctggaaacagc

SEQ ID NO: 65273 - DNA, 70 bp, Artificial Sequence
  Synthetic
gccaagcatttaggtgacactatagtatcaagacaatgtccagttgtttcagagctatgctggaaacagc

SEQ ID NO: 65274 - DNA, 70 bp, Artificial Sequence
  Synthetic
gccaagcatttaggtgacactatagttcgatcaatcaacactgcagtttcagagctatgctggaaacagc

SEQ ID NO: 65275 - DNA, 70 bp, Artificial Sequence
  Synthetic
gccaagcatttaggtgacactatagttttaagaaggaaactgggagtttcagagctatgctggaaacagc

SEQ ID NO: 65276 - DNA, 70 bp, Artificial Sequence
  Synthetic
gccaagcatttaggtgacactatagcggaagctactcagtcctccgtttcagagctatgctggaaacagc

SEQ ID NO: 65277 - DNA, 70 bp, Artificial Sequence
  Synthetic
gccaagcatttaggtgacactatagataaggtactgaagggtgatgtttcagagctatgctggaaacagc

SEQ ID NO: 65278 - DNA, 70 bp, Artificial Sequence
  Synthetic
gccaagcatttaggtgacactatagatgctcattccttagaacacgtttcagagctatgctggaaacagc

SEQ ID NO: 65279 - DNA, 70 bp, Artificial Sequence
  Synthetic
gccaagcatttaggtgacactatagttgcactggagctctgtgacgtttcagagctatgctggaaacagc

SEQ ID NO: 65280 - DNA, 70 bp, Artificial Sequence
  Synthetic
gccaagcatttaggtgacactatagagccaatcagggccttgagggtttcagagctatgctggaaacagc

SEQ ID NO: 65281 - DNA, 70 bp, Artificial Sequence
  Synthetic
gccaagcatttaggtgacactatagccacctcctggaaaactttagtttcagagctatgctggaaacagc

SEQ ID NO: 65282 - DNA, 70 bp, Artificial Sequence
  Synthetic
gccaagcatttaggtgacactatagctcccacccctcctggacctgtttcagagctatgctggaaacagc

SEQ ID NO: 65283 - DNA, 70 bp, Artificial Sequence
  Synthetic
gccaagcatttaggtgacactatagaggggtgatgagttcagtttgtttcagagctatgctggaaacagc

SEQ ID NO: 65284 - DNA, 70 bp, Artificial Sequence
  Synthetic
gccaagcatttaggtgacactataggtctgtggcaccagctaacagtttcagagctatgctggaaacagc

SEQ ID NO: 65285 - DNA, 70 bp, Artificial Sequence
  Synthetic
gccaagcatttaggtgacactatagaagctgtaagtatgatctcagtttcagagctatgctggaaacagc

SEQ ID NO: 65286 - DNA, 70 bp, Artificial Sequence
  Synthetic
gccaagcatttaggtgacactataggaagacctaggtttgagttcgtttcagagctatgctggaaacagc

SEQ ID NO: 65287 - DNA, 70 bp, Artificial Sequence
  Synthetic
gccaagcatttaggtgacactatagctcactccagcccacttcctgtttcagagctatgctggaaacagc

SEQ ID NO: 65288 - DNA, 70 bp, Artificial Sequence
  Synthetic
gccaagcatttaggtgacactatagtgcgatggggccacgtaggggtttcagagctatgctggaaacagc

SEQ ID NO: 65289 - DNA, 70 bp, Artificial Sequence
  Synthetic
gccaagcatttaggtgacactatagacagtgtgacagagtcagctgtttcagagctatgctggaaacagc

SEQ ID NO: 65290 - DNA, 70 bp, Artificial Sequence
  Synthetic
gccaagcatttaggtgacactatagggagctctaaaactgacaacgtttcagagctatgctggaaacagc

SEQ ID NO: 65291 - DNA, 70 bp, Artificial Sequence
  Synthetic
gccaagcatttaggtgacactataggttagacagtgaatgtggaagtttcagagctatgctggaaacagc

SEQ ID NO: 65292 - DNA, 70 bp, Artificial Sequence
  Synthetic
gccaagcatttaggtgacactataggcacctgcagctgctgctgagtttcagagctatgctggaaacagc

SEQ ID NO: 65293 - DNA, 70 bp, Artificial Sequence
  Synthetic
gccaagcatttaggtgacactatagatcctccaacttcacatgaagtttcagagctatgctggaaacagc

SEQ ID NO: 65294 - DNA, 70 bp, Artificial Sequence
  Synthetic
gccaagcatttaggtgacactatagatcctcacagtcaagtgacggtttcagagctatgctggaaacagc

SEQ ID NO: 65295 - DNA, 70 bp, Artificial Sequence
  Synthetic
gccaagcatttaggtgacactatagaccccttgaggacactgtgagtttcagagctatgctggaaacagc

SEQ ID NO: 65296 - DNA, 70 bp, Artificial Sequence
  Synthetic
gccaagcatttaggtgacactatagtgttttctagtacatcaagggtttcagagctatgctggaaacagc

SEQ ID NO: 65297 - DNA, 70 bp, Artificial Sequence
  Synthetic
gccaagcatttaggtgacactatagcgccctgactgagatctgaggtttcagagctatgctggaaacagc

SEQ ID NO: 65298 - DNA, 70 bp, Artificial Sequence
  Synthetic
gccaagcatttaggtgacactataggtttcccaccgactttctaggtttcagagctatgctggaaacagc

SEQ ID NO: 65299 - DNA, 70 bp, Artificial Sequence
  Synthetic
gccaagcatttaggtgacactatagttcttcagacttcagaacatgtttcagagctatgctggaaacagc

SEQ ID NO: 65300 - DNA, 70 bp, Artificial Sequence
  Synthetic
gccaagcatttaggtgacactataggaagctggatcaaagaaatcgtttcagagctatgctggaaacagc

SEQ ID NO: 65301 - DNA, 70 bp, Artificial Sequence
  Synthetic
gccaagcatttaggtgacactatagttctacagagctggatattggtttcagagctatgctggaaacagc

SEQ ID NO: 65302 - DNA, 70 bp, Artificial Sequence
  Synthetic
gccaagcatttaggtgacactatagttctcagaaggctctgctatgtttcagagctatgctggaaacagc

SEQ ID NO: 65303 - DNA, 70 bp, Artificial Sequence
  Synthetic
gccaagcatttaggtgacactatagtctaaaggagaggctgctgagtttcagagctatgctggaaacagc

SEQ ID NO: 65304 - DNA, 70 bp, Artificial Sequence
  Synthetic
gccaagcatttaggtgacactatagaggatttcatccacacagcagtttcagagctatgctggaaacagc

SEQ ID NO: 65305 - DNA, 70 bp, Artificial Sequence
  Synthetic
gccaagcatttaggtgacactatagtggactcaaacgctcatcgagtttcagagctatgctggaaacagc

SEQ ID NO: 65306 - DNA, 70 bp, Artificial Sequence
  Synthetic
gccaagcatttaggtgacactatagatccacacaccaaggagcccgtttcagagctatgctggaaacagc

SEQ ID NO: 65307 - DNA, 70 bp, Artificial Sequence
  Synthetic
gccaagcatttaggtgacactataggtcaagaacccagtatggaagtttcagagctatgctggaaacagc

SEQ ID NO: 65308 - DNA, 70 bp, Artificial Sequence
  Synthetic
gccaagcatttaggtgacactatagcgggcactggagcactgattgtttcagagctatgctggaaacagc

SEQ ID NO: 65309 - DNA, 70 bp, Artificial Sequence
  Synthetic
gccaagcatttaggtgacactataggcaggctggtcttcaacaccgtttcagagctatgctggaaacagc

SEQ ID NO: 65310 - DNA, 70 bp, Artificial Sequence
  Synthetic
gccaagcatttaggtgacactataggtgcggcgctcaggtgagcggtttcagagctatgctggaaacagc

SEQ ID NO: 65311 - DNA, 70 bp, Artificial Sequence
  Synthetic
gccaagcatttaggtgacactatagacgcagcaactgcctcgatcgtttcagagctatgctggaaacagc

SEQ ID NO: 65312 - DNA, 70 bp, Artificial Sequence
  Synthetic
gccaagcatttaggtgacactatagtccatatctatcagtgtaaggtttcagagctatgctggaaacagc

SEQ ID NO: 65313 - DNA, 70 bp, Artificial Sequence
  Synthetic
gccaagcatttaggtgacactatagttccagcccctcattgctgagtttcagagctatgctggaaacagc

SEQ ID NO: 65314 - DNA, 70 bp, Artificial Sequence
  Synthetic
gccaagcatttaggtgacactatagggagggggcacagtcacgccgtttcagagctatgctggaaacagc

SEQ ID NO: 65315 - DNA, 70 bp, Artificial Sequence
  Synthetic
gccaagcatttaggtgacactatagtgaagaagctgaagaaaaacgtttcagagctatgctggaaacagc

SEQ ID NO: 65316 - DNA, 70 bp, Artificial Sequence
  Synthetic
gccaagcatttaggtgacactatagaaagaagggcttttatcttggtttcagagctatgctggaaacagc

SEQ ID NO: 65317 - DNA, 70 bp, Artificial Sequence
  Synthetic
gccaagcatttaggtgacactatagagcactttaaccaacttctagtttcagagctatgctggaaacagc

SEQ ID NO: 65318 - DNA, 70 bp, Artificial Sequence
  Synthetic
gccaagcatttaggtgacactatagagtaacgatagcattactcagtttcagagctatgctggaaacagc

SEQ ID NO: 65319 - DNA, 70 bp, Artificial Sequence
  Synthetic
gccaagcatttaggtgacactatagcacagaactccatcaagacggtttcagagctatgctggaaacagc

SEQ ID NO: 65320 - DNA, 70 bp, Artificial Sequence
  Synthetic
gccaagcatttaggtgacactatagtcggattgagtatgcttgacgtttcagagctatgctggaaacagc

SEQ ID NO: 65321 - DNA, 70 bp, Artificial Sequence
  Synthetic
gccaagcatttaggtgacactatagaaggctcacagctttgtctcgtttcagagctatgctggaaacagc

SEQ ID NO: 65322 - DNA, 70 bp, Artificial Sequence
  Synthetic
gccaagcatttaggtgacactatagcggtgagatgctacctaccagtttcagagctatgctggaaacagc

SEQ ID NO: 65323 - DNA, 70 bp, Artificial Sequence
  Synthetic
gccaagcatttaggtgacactatagcttgatggccctaaaggaacgtttcagagctatgctggaaacagc

SEQ ID NO: 65324 - DNA, 70 bp, Artificial Sequence
  Synthetic
gccaagcatttaggtgacactataggacgaggtgtctcggatagtgtttcagagctatgctggaaacagc

SEQ ID NO: 65325 - DNA, 70 bp, Artificial Sequence
  Synthetic
gccaagcatttaggtgacactatagcttgatgccttctgacttctgtttcagagctatgctggaaacagc

SEQ ID NO: 65326 - DNA, 70 bp, Artificial Sequence
  Synthetic
gccaagcatttaggtgacactatagcacagataaacttggtcttcgtttcagagctatgctggaaacagc

SEQ ID NO: 65327 - DNA, 70 bp, Artificial Sequence
  Synthetic
gccaagcatttaggtgacactatagtccgttctcagctcctcacagtttcagagctatgctggaaacagc

SEQ ID NO: 65328 - DNA, 70 bp, Artificial Sequence
  Synthetic
gccaagcatttaggtgacactatagtccttattctgctgaatgacgtttcagagctatgctggaaacagc

SEQ ID NO: 65329 - DNA, 70 bp, Artificial Sequence
  Synthetic
gccaagcatttaggtgacactataggggattcaaacattcatgaggtttcagagctatgctggaaacagc

SEQ ID NO: 65330 - DNA, 70 bp, Artificial Sequence
  Synthetic
gccaagcatttaggtgacactatagcggggtcacgattgtgcgtggtttcagagctatgctggaaacagc

SEQ ID NO: 65331 - DNA, 70 bp, Artificial Sequence
  Synthetic
gccaagcatttaggtgacactatagctccagctgggatcaccaacgtttcagagctatgctggaaacagc

SEQ ID NO: 65332 - DNA, 70 bp, Artificial Sequence
  Synthetic
gccaagcatttaggtgacactatagtgttggtattgtggttggtagtttcagagctatgctggaaacagc

SEQ ID NO: 65333 - DNA, 70 bp, Artificial Sequence
  Synthetic
gccaagcatttaggtgacactataggagatgccaagaacaggaaagtttcagagctatgctggaaacagc

SEQ ID NO: 65334 - DNA, 70 bp, Artificial Sequence
  Synthetic
gccaagcatttaggtgacactataggggttctgggagctgctagagtttcagagctatgctggaaacagc

SEQ ID NO: 65335 - DNA, 70 bp, Artificial Sequence
  Synthetic
gccaagcatttaggtgacactatagagcaaggattcaaggctttcgtttcagagctatgctggaaacagc

SEQ ID NO: 65336 - DNA, 70 bp, Artificial Sequence
  Synthetic
gccaagcatttaggtgacactatagaagtggttcacgcatggtgggtttcagagctatgctggaaacagc

SEQ ID NO: 65337 - DNA, 70 bp, Artificial Sequence
  Synthetic
gccaagcatttaggtgacactatagtcccatgagagtgcataaccgtttcagagctatgctggaaacagc

SEQ ID NO: 65338 - DNA, 70 bp, Artificial Sequence
  Synthetic
gccaagcatttaggtgacactatagcaggcctttcatttcacctcgtttcagagctatgctggaaacagc

SEQ ID NO: 65339 - DNA, 70 bp, Artificial Sequence
  Synthetic
gccaagcatttaggtgacactatagactgaagattagacatggttgtttcagagctatgctggaaacagc

SEQ ID NO: 65340 - DNA, 70 bp, Artificial Sequence
  Synthetic
gccaagcatttaggtgacactataggagctaacatttccctttgagtttcagagctatgctggaaacagc

SEQ ID NO: 65341 - DNA, 70 bp, Artificial Sequence
  Synthetic
gccaagcatttaggtgacactatagtactggcaggatctgtcacagtttcagagctatgctggaaacagc

SEQ ID NO: 65342 - DNA, 70 bp, Artificial Sequence
  Synthetic
gccaagcatttaggtgacactatagcacattactgtgaccctctcgtttcagagctatgctggaaacagc

SEQ ID NO: 65343 - DNA, 70 bp, Artificial Sequence
  Synthetic
gccaagcatttaggtgacactatagtacccagactgagctggaacgtttcagagctatgctggaaacagc

SEQ ID NO: 65344 - DNA, 70 bp, Artificial Sequence
  Synthetic
gccaagcatttaggtgacactatagtgcagatacccagactgagcgtttcagagctatgctggaaacagc

SEQ ID NO: 65345 - DNA, 70 bp, Artificial Sequence
  Synthetic
gccaagcatttaggtgacactataggagaagacgagccacgtatggtttcagagctatgctggaaacagc

SEQ ID NO: 65346 - DNA, 70 bp, Artificial Sequence
  Synthetic
gccaagcatttaggtgacactataggtcatcaagaggatttgagcgtttcagagctatgctggaaacagc

SEQ ID NO: 65347 - DNA, 70 bp, Artificial Sequence
  Synthetic
gccaagcatttaggtgacactatagggatccgccagggctgggaagtttcagagctatgctggaaacagc

SEQ ID NO: 65348 - DNA, 70 bp, Artificial Sequence
  Synthetic
gccaagcatttaggtgacactatagacctcatgccaagtgtagaagtttcagagctatgctggaaacagc

SEQ ID NO: 65349 - DNA, 70 bp, Artificial Sequence
  Synthetic
gccaagcatttaggtgacactatagatctgctttagcgtttcagagtttcagagctatgctggaaacagc

SEQ ID NO: 65350 - DNA, 70 bp, Artificial Sequence
  Synthetic
gccaagcatttaggtgacactatagaagcctcttaagaagtaggcgtttcagagctatgctggaaacagc

SEQ ID NO: 65351 - DNA, 70 bp, Artificial Sequence
  Synthetic
gccaagcatttaggtgacactatagcacgctggcggtcactcatggtttcagagctatgctggaaacagc

SEQ ID NO: 65352 - DNA, 70 bp, Artificial Sequence
  Synthetic
gccaagcatttaggtgacactatagccacatgacctttgtcataagtttcagagctatgctggaaacagc

SEQ ID NO: 65353 - DNA, 70 bp, Artificial Sequence
  Synthetic
gccaagcatttaggtgacactatagttttgcacgcaccgagcccagtttcagagctatgctggaaacagc

SEQ ID NO: 65354 - DNA, 70 bp, Artificial Sequence
  Synthetic
gccaagcatttaggtgacactatagatgtgggtctgattgcaattgtttcagagctatgctggaaacagc

SEQ ID NO: 65355 - DNA, 70 bp, Artificial Sequence
  Synthetic
gccaagcatttaggtgacactataggttcttcccctacagttctggtttcagagctatgctggaaacagc

SEQ ID NO: 65356 - DNA, 70 bp, Artificial Sequence
  Synthetic
gccaagcatttaggtgacactatagtcggcctgcaagcagcagtggtttcagagctatgctggaaacagc

SEQ ID NO: 65357 - DNA, 70 bp, Artificial Sequence
  Synthetic
gccaagcatttaggtgacactatagggtcagcgtgggaccctcatgtttcagagctatgctggaaacagc

SEQ ID NO: 65358 - DNA, 70 bp, Artificial Sequence
  Synthetic
gccaagcatttaggtgacactatagacatgctgctttttcagattgtttcagagctatgctggaaacagc

SEQ ID NO: 65359 - DNA, 70 bp, Artificial Sequence
  Synthetic
gccaagcatttaggtgacactataggctcagtagataaattctccgtttcagagctatgctggaaacagc

SEQ ID NO: 65360 - DNA, 70 bp, Artificial Sequence
  Synthetic
gccaagcatttaggtgacactatagtgaaacaagttcatggggatgtttcagagctatgctggaaacagc

SEQ ID NO: 65361 - DNA, 70 bp, Artificial Sequence
  Synthetic
gccaagcatttaggtgacactataggagcagaatcttcatgtctcgtttcagagctatgctggaaacagc

SEQ ID NO: 65362 - DNA, 70 bp, Artificial Sequence
  Synthetic
gccaagcatttaggtgacactatagaaatgccaaaggaatttcaggtttcagagctatgctggaaacagc

SEQ ID NO: 65363 - DNA, 70 bp, Artificial Sequence
  Synthetic
gccaagcatttaggtgacactatagtgaacagcagtgcgcttcaggtttcagagctatgctggaaacagc

SEQ ID NO: 65364 - DNA, 70 bp, Artificial Sequence
  Synthetic
gccaagcatttaggtgacactatagtcccggcatcacagataaaagtttcagagctatgctggaaacagc

SEQ ID NO: 65365 - DNA, 70 bp, Artificial Sequence
  Synthetic
gccaagcatttaggtgacactatagcgatggatgcaaagaaaagagtttcagagctatgctggaaacagc

SEQ ID NO: 65366 - DNA, 70 bp, Artificial Sequence
  Synthetic
gccaagcatttaggtgacactatagtgtatggagaagacaagaaagtttcagagctatgctggaaacagc

SEQ ID NO: 65367 - DNA, 70 bp, Artificial Sequence
  Synthetic
gccaagcatttaggtgacactatagaaagacccacaaggtgaggagtttcagagctatgctggaaacagc

SEQ ID NO: 65368 - DNA, 70 bp, Artificial Sequence
  Synthetic
gccaagcatttaggtgacactatagacctcgaaagtttcataaaggtttcagagctatgctggaaacagc

SEQ ID NO: 65369 - DNA, 70 bp, Artificial Sequence
  Synthetic
gccaagcatttaggtgacactatagtcctacaagtcccactgaatgtttcagagctatgctggaaacagc

SEQ ID NO: 65370 - DNA, 70 bp, Artificial Sequence
  Synthetic
gccaagcatttaggtgacactataggggctcagctgctgcagccagtttcagagctatgctggaaacagc

SEQ ID NO: 65371 - DNA, 70 bp, Artificial Sequence
  Synthetic
gccaagcatttaggtgacactataggccgtgagtggcgaaggggagtttcagagctatgctggaaacagc

SEQ ID NO: 65372 - DNA, 70 bp, Artificial Sequence
  Synthetic
gccaagcatttaggtgacactatagacggaggagtgaggggggcggtttcagagctatgctggaaacagc

SEQ ID NO: 65373 - DNA, 70 bp, Artificial Sequence
  Synthetic
gccaagcatttaggtgacactatagtcggccgggagcggctaggcgtttcagagctatgctggaaacagc

SEQ ID NO: 65374 - DNA, 70 bp, Artificial Sequence
  Synthetic
gccaagcatttaggtgacactatagtggcattgctacttccatgagtttcagagctatgctggaaacagc

SEQ ID NO: 65375 - DNA, 70 bp, Artificial Sequence
  Synthetic
gccaagcatttaggtgacactatagttctgtggcccatcaagagggtttcagagctatgctggaaacagc

SEQ ID NO: 65376 - DNA, 70 bp, Artificial Sequence
  Synthetic
gccaagcatttaggtgacactatagcaactgcaacctctgcctccgtttcagagctatgctggaaacagc

SEQ ID NO: 65377 - DNA, 70 bp, Artificial Sequence
  Synthetic
gccaagcatttaggtgacactataggtttctttttggttctggacgtttcagagctatgctggaaacagc

SEQ ID NO: 65378 - DNA, 70 bp, Artificial Sequence
  Synthetic
gccaagcatttaggtgacactatagtttaagcagcacatgtgaccgtttcagagctatgctggaaacagc

SEQ ID NO: 65379 - DNA, 70 bp, Artificial Sequence
  Synthetic
gccaagcatttaggtgacactataggaatctggaatcacatgctagtttcagagctatgctggaaacagc

SEQ ID NO: 65380 - DNA, 70 bp, Artificial Sequence
  Synthetic
gccaagcatttaggtgacactatagtttgctgctttcatgtaggagtttcagagctatgctggaaacagc

SEQ ID NO: 65381 - DNA, 70 bp, Artificial Sequence
  Synthetic
gccaagcatttaggtgacactatagtccccacctacatgaaagctgtttcagagctatgctggaaacagc

SEQ ID NO: 65382 - DNA, 70 bp, Artificial Sequence
  Synthetic
gccaagcatttaggtgacactatagctgatgaagtgaagctgattgtttcagagctatgctggaaacagc

SEQ ID NO: 65383 - DNA, 70 bp, Artificial Sequence
  Synthetic
gccaagcatttaggtgacactatagccatagaggctaagaagagagtttcagagctatgctggaaacagc

SEQ ID NO: 65384 - DNA, 70 bp, Artificial Sequence
  Synthetic
gccaagcatttaggtgacactatagagaaagcgtatctacacagcgtttcagagctatgctggaaacagc

SEQ ID NO: 65385 - DNA, 70 bp, Artificial Sequence
  Synthetic
gccaagcatttaggtgacactataggctgaggctgttatttccgcgtttcagagctatgctggaaacagc

SEQ ID NO: 65386 - DNA, 70 bp, Artificial Sequence
  Synthetic
gccaagcatttaggtgacactataggtgcaccacgtctgggggacgtttcagagctatgctggaaacagc

SEQ ID NO: 65387 - DNA, 70 bp, Artificial Sequence
  Synthetic
gccaagcatttaggtgacactataggcaaggccctttatttctctgtttcagagctatgctggaaacagc

SEQ ID NO: 65388 - DNA, 70 bp, Artificial Sequence
  Synthetic
gccaagcatttaggtgacactatagtcagcttcagtctcgtcagcgtttcagagctatgctggaaacagc

SEQ ID NO: 65389 - DNA, 70 bp, Artificial Sequence
  Synthetic
gccaagcatttaggtgacactataggaactccaggttgaactgtcgtttcagagctatgctggaaacagc

SEQ ID NO: 65390 - DNA, 70 bp, Artificial Sequence
  Synthetic
gccaagcatttaggtgacactatagtttctggagcttcagagggagtttcagagctatgctggaaacagc

SEQ ID NO: 65391 - DNA, 70 bp, Artificial Sequence
  Synthetic
gccaagcatttaggtgacactatagccccttcacactttacagcagtttcagagctatgctggaaacagc

SEQ ID NO: 65392 - DNA, 70 bp, Artificial Sequence
  Synthetic
gccaagcatttaggtgacactatagcccgggagtcaccgcgcagcgtttcagagctatgctggaaacagc

SEQ ID NO: 65393 - DNA, 70 bp, Artificial Sequence
  Synthetic
gccaagcatttaggtgacactatagtttggcctctaggctttaccgtttcagagctatgctggaaacagc

SEQ ID NO: 65394 - DNA, 70 bp, Artificial Sequence
  Synthetic
gccaagcatttaggtgacactatagagtagactatgtcatctgctgtttcagagctatgctggaaacagc

SEQ ID NO: 65395 - DNA, 70 bp, Artificial Sequence
  Synthetic
gccaagcatttaggtgacactataggctggcatcaccaccacaccgtttcagagctatgctggaaacagc

SEQ ID NO: 65396 - DNA, 70 bp, Artificial Sequence
  Synthetic
gccaagcatttaggtgacactataggagtgacattgtcagcacaagtttcagagctatgctggaaacagc

SEQ ID NO: 65397 - DNA, 70 bp, Artificial Sequence
  Synthetic
gccaagcatttaggtgacactatagcatctctacactagcctagagtttcagagctatgctggaaacagc

SEQ ID NO: 65398 - DNA, 70 bp, Artificial Sequence
  Synthetic
gccaagcatttaggtgacactatagggtggagcgtgtggaaattagtttcagagctatgctggaaacagc

SEQ ID NO: 65399 - DNA, 70 bp, Artificial Sequence
  Synthetic
gccaagcatttaggtgacactataggtgaactcagagtctcaaaggtttcagagctatgctggaaacagc

SEQ ID NO: 65400 - DNA, 70 bp, Artificial Sequence
  Synthetic
gccaagcatttaggtgacactatagcagccaaggctgctacttcagtttcagagctatgctggaaacagc

SEQ ID NO: 65401 - DNA, 70 bp, Artificial Sequence
  Synthetic
gccaagcatttaggtgacactatagatcgagtcaagatgagttaggtttcagagctatgctggaaacagc

SEQ ID NO: 65402 - DNA, 70 bp, Artificial Sequence
  Synthetic
gccaagcatttaggtgacactatagaagcttccaaataaagcctggtttcagagctatgctggaaacagc

SEQ ID NO: 65403 - DNA, 70 bp, Artificial Sequence
  Synthetic
gccaagcatttaggtgacactatagtggtgactgcataactcagtgtttcagagctatgctggaaacagc

SEQ ID NO: 65404 - DNA, 70 bp, Artificial Sequence
  Synthetic
gccaagcatttaggtgacactatagaagccattggtgatgcagaggtttcagagctatgctggaaacagc

SEQ ID NO: 65405 - DNA, 70 bp, Artificial Sequence
  Synthetic
gccaagcatttaggtgacactataggagataccagggttcgtcatgtttcagagctatgctggaaacagc

SEQ ID NO: 65406 - DNA, 70 bp, Artificial Sequence
  Synthetic
gccaagcatttaggtgacactatagggcatcatctatcagaacaagtttcagagctatgctggaaacagc

SEQ ID NO: 65407 - DNA, 70 bp, Artificial Sequence
  Synthetic
gccaagcatttaggtgacactatagtaaggcagtaagaggttaccgtttcagagctatgctggaaacagc

SEQ ID NO: 65408 - DNA, 70 bp, Artificial Sequence
  Synthetic
gccaagcatttaggtgacactatagacgtttatgactggagttaggtttcagagctatgctggaaacagc

SEQ ID NO: 65409 - DNA, 70 bp, Artificial Sequence
  Synthetic
gccaagcatttaggtgacactatagcgtttgatgaaacattacccgtttcagagctatgctggaaacagc

SEQ ID NO: 65410 - DNA, 70 bp, Artificial Sequence
  Synthetic
gccaagcatttaggtgacactataggccagcttccatgacatatcgtttcagagctatgctggaaacagc

SEQ ID NO: 65411 - DNA, 70 bp, Artificial Sequence
  Synthetic
gccaagcatttaggtgacactatagaacagaagcttgcaagcagtgtttcagagctatgctggaaacagc

SEQ ID NO: 65412 - DNA, 70 bp, Artificial Sequence
  Synthetic
gccaagcatttaggtgacactatagaaatggatcccggttctgtagtttcagagctatgctggaaacagc

SEQ ID NO: 65413 - DNA, 70 bp, Artificial Sequence
  Synthetic
gccaagcatttaggtgacactatagaggaaatctcattggtgaaagtttcagagctatgctggaaacagc

SEQ ID NO: 65414 - DNA, 70 bp, Artificial Sequence
  Synthetic
gccaagcatttaggtgacactatagccaacagcatctcagtgtaggtttcagagctatgctggaaacagc

SEQ ID NO: 65415 - DNA, 70 bp, Artificial Sequence
  Synthetic
gccaagcatttaggtgacactatagctggctctagagcgtgcagagtttcagagctatgctggaaacagc

SEQ ID NO: 65416 - DNA, 70 bp, Artificial Sequence
  Synthetic
gccaagcatttaggtgacactatagacgggaataaaataggttgtgtttcagagctatgctggaaacagc

SEQ ID NO: 65417 - DNA, 70 bp, Artificial Sequence
  Synthetic
gccaagcatttaggtgacactatagtgaagaaaaggctatgctctgtttcagagctatgctggaaacagc

SEQ ID NO: 65418 - DNA, 70 bp, Artificial Sequence
  Synthetic
gccaagcatttaggtgacactatagccaatggtgcccagccctgagtttcagagctatgctggaaacagc

SEQ ID NO: 65419 - DNA, 70 bp, Artificial Sequence
  Synthetic
gccaagcatttaggtgacactatagagaacactaggttcaaatccgtttcagagctatgctggaaacagc

SEQ ID NO: 65420 - DNA, 70 bp, Artificial Sequence
  Synthetic
gccaagcatttaggtgacactatagatgatcatctcttcatcaacgtttcagagctatgctggaaacagc

SEQ ID NO: 65421 - DNA, 70 bp, Artificial Sequence
  Synthetic
gccaagcatttaggtgacactatagagagctggaggtggacgattgtttcagagctatgctggaaacagc

SEQ ID NO: 65422 - DNA, 70 bp, Artificial Sequence
  Synthetic
gccaagcatttaggtgacactatagagagggtgctcaggagggtagtttcagagctatgctggaaacagc

SEQ ID NO: 65423 - DNA, 70 bp, Artificial Sequence
  Synthetic
gccaagcatttaggtgacactatagtgaagaaagagtggttcagggtttcagagctatgctggaaacagc

SEQ ID NO: 65424 - DNA, 70 bp, Artificial Sequence
  Synthetic
gccaagcatttaggtgacactataggactcatactgggaattctagtttcagagctatgctggaaacagc

SEQ ID NO: 65425 - DNA, 70 bp, Artificial Sequence
  Synthetic
gccaagcatttaggtgacactataggacaataaactgcttgctgagtttcagagctatgctggaaacagc

SEQ ID NO: 65426 - DNA, 70 bp, Artificial Sequence
  Synthetic
gccaagcatttaggtgacactatagtccttcagctcctgatgttagtttcagagctatgctggaaacagc

SEQ ID NO: 65427 - DNA, 70 bp, Artificial Sequence
  Synthetic
gccaagcatttaggtgacactatagtgctaaaagaatgagtagtggtttcagagctatgctggaaacagc

SEQ ID NO: 65428 - DNA, 70 bp, Artificial Sequence
  Synthetic
gccaagcatttaggtgacactatagtgtagagacaggctcatagcgtttcagagctatgctggaaacagc

SEQ ID NO: 65429 - DNA, 70 bp, Artificial Sequence
  Synthetic
gccaagcatttaggtgacactatagtgggaagagctgctgcagtggtttcagagctatgctggaaacagc

SEQ ID NO: 65430 - DNA, 70 bp, Artificial Sequence
  Synthetic
gccaagcatttaggtgacactatagaagaacttagtcagtgattcgtttcagagctatgctggaaacagc

SEQ ID NO: 65431 - DNA, 70 bp, Artificial Sequence
  Synthetic
gccaagcatttaggtgacactatagctccaggaagtcaagagcttgtttcagagctatgctggaaacagc

SEQ ID NO: 65432 - DNA, 70 bp, Artificial Sequence
  Synthetic
gccaagcatttaggtgacactatagcagtgctggagctgacgcacgtttcagagctatgctggaaacagc

SEQ ID NO: 65433 - DNA, 70 bp, Artificial Sequence
  Synthetic
gccaagcatttaggtgacactatagaaagcatatatagctagtgcgtttcagagctatgctggaaacagc

SEQ ID NO: 65434 - DNA, 70 bp, Artificial Sequence
  Synthetic
gccaagcatttaggtgacactatagtgggcatcatacgaagacctgtttcagagctatgctggaaacagc

SEQ ID NO: 65435 - DNA, 70 bp, Artificial Sequence
  Synthetic
gccaagcatttaggtgacactatagtggtccccaggcgctgctaggtttcagagctatgctggaaacagc

SEQ ID NO: 65436 - DNA, 70 bp, Artificial Sequence
  Synthetic
gccaagcatttaggtgacactatagtggataatcgaggcttgtcagtttcagagctatgctggaaacagc

SEQ ID NO: 65437 - DNA, 70 bp, Artificial Sequence
  Synthetic
gccaagcatttaggtgacactatagaatgtagccacgcttcctttgtttcagagctatgctggaaacagc

SEQ ID NO: 65438 - DNA, 70 bp, Artificial Sequence
  Synthetic
gccaagcatttaggtgacactatagggctgggtggaggactactggtttcagagctatgctggaaacagc

SEQ ID NO: 65439 - DNA, 70 bp, Artificial Sequence
  Synthetic
gccaagcatttaggtgacactatagccgtgggctcacagctgctggtttcagagctatgctggaaacagc

SEQ ID NO: 65440 - DNA, 70 bp, Artificial Sequence
  Synthetic
gccaagcatttaggtgacactatagacgagaaggtcaggggtcacgtttcagagctatgctggaaacagc

SEQ ID NO: 65441 - DNA, 70 bp, Artificial Sequence
  Synthetic
gccaagcatttaggtgacactatagactcgtcatgtgggatacttgtttcagagctatgctggaaacagc

SEQ ID NO: 65442 - DNA, 70 bp, Artificial Sequence
  Synthetic
gccaagcatttaggtgacactatagagaatagtaagatgagaacggtttcagagctatgctggaaacagc

SEQ ID NO: 65443 - DNA, 70 bp, Artificial Sequence
  Synthetic
gccaagcatttaggtgacactatagctgtccctgcctcaagtagcgtttcagagctatgctggaaacagc

SEQ ID NO: 65444 - DNA, 70 bp, Artificial Sequence
  Synthetic
gccaagcatttaggtgacactatagtcactgacaggacaagcaccgtttcagagctatgctggaaacagc

SEQ ID NO: 65445 - DNA, 70 bp, Artificial Sequence
  Synthetic
gccaagcatttaggtgacactatagtggcgtgaagtctcgataaggtttcagagctatgctggaaacagc

SEQ ID NO: 65446 - DNA, 70 bp, Artificial Sequence
  Synthetic
gccaagcatttaggtgacactatagaactgcatttcttgtcagttgtttcagagctatgctggaaacagc

SEQ ID NO: 65447 - DNA, 70 bp, Artificial Sequence
  Synthetic
gccaagcatttaggtgacactataggactggtacgacagctagccgtttcagagctatgctggaaacagc

SEQ ID NO: 65448 - DNA, 70 bp, Artificial Sequence
  Synthetic
gccaagcatttaggtgacactatagcttgcagagtactgtgttgtgtttcagagctatgctggaaacagc

SEQ ID NO: 65449 - DNA, 70 bp, Artificial Sequence
  Synthetic
gccaagcatttaggtgacactatagagtaccagagcaaggcgcgcgtttcagagctatgctggaaacagc

SEQ ID NO: 65450 - DNA, 70 bp, Artificial Sequence
  Synthetic
gccaagcatttaggtgacactataggtcatcgcctccactgttgggtttcagagctatgctggaaacagc

SEQ ID NO: 65451 - DNA, 70 bp, Artificial Sequence
  Synthetic
gccaagcatttaggtgacactatagtggggggacgctgggcttgtgtttcagagctatgctggaaacagc

SEQ ID NO: 65452 - DNA, 70 bp, Artificial Sequence
  Synthetic
gccaagcatttaggtgacactatagcaaggcaagaagggtgagttgtttcagagctatgctggaaacagc

SEQ ID NO: 65453 - DNA, 70 bp, Artificial Sequence
  Synthetic
gccaagcatttaggtgacactataggcttgtcagttggcaaatgagtttcagagctatgctggaaacagc

SEQ ID NO: 65454 - DNA, 70 bp, Artificial Sequence
  Synthetic
gccaagcatttaggtgacactataggtctgagtctcaaggataaagtttcagagctatgctggaaacagc

SEQ ID NO: 65455 - DNA, 70 bp, Artificial Sequence
  Synthetic
gccaagcatttaggtgacactatagttgttgctaggataattccagtttcagagctatgctggaaacagc

SEQ ID NO: 65456 - DNA, 70 bp, Artificial Sequence
  Synthetic
gccaagcatttaggtgacactatagccactcttaattcagcccaagtttcagagctatgctggaaacagc

SEQ ID NO: 65457 - DNA, 70 bp, Artificial Sequence
  Synthetic
gccaagcatttaggtgacactatagtccattctcatctgaagacagtttcagagctatgctggaaacagc

SEQ ID NO: 65458 - DNA, 70 bp, Artificial Sequence
  Synthetic
gccaagcatttaggtgacactatagatcattggcgtcacagtggtgtttcagagctatgctggaaacagc

SEQ ID NO: 65459 - DNA, 70 bp, Artificial Sequence
  Synthetic
gccaagcatttaggtgacactatagaggatcgacgagaacgtgctgtttcagagctatgctggaaacagc

SEQ ID NO: 65460 - DNA, 70 bp, Artificial Sequence
  Synthetic
gccaagcatttaggtgacactataggagtagagagggttcaagcagtttcagagctatgctggaaacagc

SEQ ID NO: 65461 - DNA, 70 bp, Artificial Sequence
  Synthetic
gccaagcatttaggtgacactatagtcctcttcttagtgctgtgagtttcagagctatgctggaaacagc

SEQ ID NO: 65462 - DNA, 70 bp, Artificial Sequence
  Synthetic
gccaagcatttaggtgacactataggattcctgcatgttgatgtggtttcagagctatgctggaaacagc

SEQ ID NO: 65463 - DNA, 70 bp, Artificial Sequence
  Synthetic
gccaagcatttaggtgacactataggtgctcctttataacttcaggtttcagagctatgctggaaacagc

SEQ ID NO: 65464 - DNA, 70 bp, Artificial Sequence
  Synthetic
gccaagcatttaggtgacactataggtctctttactgccatcagtgtttcagagctatgctggaaacagc

SEQ ID NO: 65465 - DNA, 70 bp, Artificial Sequence
  Synthetic
gccaagcatttaggtgacactatagcctcaccccacagaaactgcgtttcagagctatgctggaaacagc

SEQ ID NO: 65466 - DNA, 70 bp, Artificial Sequence
  Synthetic
gccaagcatttaggtgacactatagtttggctctcactccattgtgtttcagagctatgctggaaacagc

SEQ ID NO: 65467 - DNA, 70 bp, Artificial Sequence
  Synthetic
gccaagcatttaggtgacactataggcggggccaggggtcagggcgtttcagagctatgctggaaacagc

SEQ ID NO: 65468 - DNA, 70 bp, Artificial Sequence
  Synthetic
gccaagcatttaggtgacactatagaaagatgctgaataaacccagtttcagagctatgctggaaacagc

SEQ ID NO: 65469 - DNA, 70 bp, Artificial Sequence
  Synthetic
gccaagcatttaggtgacactatagtccccaaccagaaaagttgagtttcagagctatgctggaaacagc

SEQ ID NO: 65470 - DNA, 70 bp, Artificial Sequence
  Synthetic
gccaagcatttaggtgacactatagtggattctggttgtcagaacgtttcagagctatgctggaaacagc

SEQ ID NO: 65471 - DNA, 70 bp, Artificial Sequence
  Synthetic
gccaagcatttaggtgacactatagtttggaaaatgcttctgcacgtttcagagctatgctggaaacagc

SEQ ID NO: 65472 - DNA, 70 bp, Artificial Sequence
  Synthetic
gccaagcatttaggtgacactatagttctcaacatttgtgcttcagtttcagagctatgctggaaacagc

SEQ ID NO: 65473 - DNA, 70 bp, Artificial Sequence
  Synthetic
gccaagcatttaggtgacactataggcatgctatagttgtagaaggtttcagagctatgctggaaacagc

SEQ ID NO: 65474 - DNA, 70 bp, Artificial Sequence
  Synthetic
gccaagcatttaggtgacactatagcaagtggcgactgcacagaagtttcagagctatgctggaaacagc

SEQ ID NO: 65475 - DNA, 70 bp, Artificial Sequence
  Synthetic
gccaagcatttaggtgacactatagctcggagaagatcagtagaggtttcagagctatgctggaaacagc

SEQ ID NO: 65476 - DNA, 70 bp, Artificial Sequence
  Synthetic
gccaagcatttaggtgacactatagtctgctcgttactatgcatggtttcagagctatgctggaaacagc

SEQ ID NO: 65477 - DNA, 70 bp, Artificial Sequence
  Synthetic
gccaagcatttaggtgacactatagcagaaatctgttccttcagcgtttcagagctatgctggaaacagc

SEQ ID NO: 65478 - DNA, 70 bp, Artificial Sequence
  Synthetic
gccaagcatttaggtgacactatagactgggttttcagatcatatgtttcagagctatgctggaaacagc

SEQ ID NO: 65479 - DNA, 70 bp, Artificial Sequence
  Synthetic
gccaagcatttaggtgacactataggctgggaaccacgatctacagtttcagagctatgctggaaacagc

SEQ ID NO: 65480 - DNA, 70 bp, Artificial Sequence
  Synthetic
gccaagcatttaggtgacactatagaggacaaagacatcacttctgtttcagagctatgctggaaacagc

SEQ ID NO: 65481 - DNA, 70 bp, Artificial Sequence
  Synthetic
gccaagcatttaggtgacactatagtggcacacttactcagatttgtttcagagctatgctggaaacagc

SEQ ID NO: 65482 - DNA, 70 bp, Artificial Sequence
  Synthetic
gccaagcatttaggtgacactatagttcattcagagaaaagtgaggtttcagagctatgctggaaacagc

SEQ ID NO: 65483 - DNA, 70 bp, Artificial Sequence
  Synthetic
gccaagcatttaggtgacactatagtttggtgttacagcagtctcgtttcagagctatgctggaaacagc

SEQ ID NO: 65484 - DNA, 70 bp, Artificial Sequence
  Synthetic
gccaagcatttaggtgacactatagaaagtcaagcagctgagcgcgtttcagagctatgctggaaacagc

SEQ ID NO: 65485 - DNA, 70 bp, Artificial Sequence
  Synthetic
gccaagcatttaggtgacactatagcttacgcggctcatggacccgtttcagagctatgctggaaacagc

SEQ ID NO: 65486 - DNA, 70 bp, Artificial Sequence
  Synthetic
gccaagcatttaggtgacactataggacagtccgctacactagccgtttcagagctatgctggaaacagc

SEQ ID NO: 65487 - DNA, 70 bp, Artificial Sequence
  Synthetic
gccaagcatttaggtgacactatagtttgtcagtgagtttcatgtgtttcagagctatgctggaaacagc

SEQ ID NO: 65488 - DNA, 70 bp, Artificial Sequence
  Synthetic
gccaagcatttaggtgacactatagttccagaacactcagtagtagtttcagagctatgctggaaacagc

SEQ ID NO: 65489 - DNA, 70 bp, Artificial Sequence
  Synthetic
gccaagcatttaggtgacactataggcagatgtacagacacaagcgtttcagagctatgctggaaacagc

SEQ ID NO: 65490 - DNA, 70 bp, Artificial Sequence
  Synthetic
gccaagcatttaggtgacactatagatcctcctgatgatatggaagtttcagagctatgctggaaacagc

SEQ ID NO: 65491 - DNA, 70 bp, Artificial Sequence
  Synthetic
gccaagcatttaggtgacactatagcagttatgggatggatgggagtttcagagctatgctggaaacagc

SEQ ID NO: 65492 - DNA, 70 bp, Artificial Sequence
  Synthetic
gccaagcatttaggtgacactatagcaactgtgggaaggctgggagtttcagagctatgctggaaacagc

SEQ ID NO: 65493 - DNA, 70 bp, Artificial Sequence
  Synthetic
gccaagcatttaggtgacactatagttccgctctgagctgtgagagtttcagagctatgctggaaacagc

SEQ ID NO: 65494 - DNA, 70 bp, Artificial Sequence
  Synthetic
gccaagcatttaggtgacactatagagacactttaaatctctgtggtttcagagctatgctggaaacagc

SEQ ID NO: 65495 - DNA, 70 bp, Artificial Sequence
  Synthetic
gccaagcatttaggtgacactatagaacctccataaacttctgcagtttcagagctatgctggaaacagc

SEQ ID NO: 65496 - DNA, 70 bp, Artificial Sequence
  Synthetic
gccaagcatttaggtgacactatagagatctctgtgcggaaggttgtttcagagctatgctggaaacagc

SEQ ID NO: 65497 - DNA, 70 bp, Artificial Sequence
  Synthetic
gccaagcatttaggtgacactatagcttctgcctggagatctgaggtttcagagctatgctggaaacagc

SEQ ID NO: 65498 - DNA, 70 bp, Artificial Sequence
  Synthetic
gccaagcatttaggtgacactatagttccacttccagttctagtagtttcagagctatgctggaaacagc

SEQ ID NO: 65499 - DNA, 70 bp, Artificial Sequence
  Synthetic
gccaagcatttaggtgacactatagtttcgaactgagatctaagagtttcagagctatgctggaaacagc

SEQ ID NO: 65500 - DNA, 70 bp, Artificial Sequence
  Synthetic
gccaagcatttaggtgacactatagtgttttggacgttattcccagtttcagagctatgctggaaacagc

SEQ ID NO: 65501 - DNA, 70 bp, Artificial Sequence
  Synthetic
gccaagcatttaggtgacactatagcgtgtttattatgagggtcggtttcagagctatgctggaaacagc

SEQ ID NO: 65502 - DNA, 70 bp, Artificial Sequence
  Synthetic
gccaagcatttaggtgacactatagaaacttctcattcatggagagtttcagagctatgctggaaacagc

SEQ ID NO: 65503 - DNA, 70 bp, Artificial Sequence
  Synthetic
gccaagcatttaggtgacactataggaattgactggaatcaacccgtttcagagctatgctggaaacagc

SEQ ID NO: 65504 - DNA, 70 bp, Artificial Sequence
  Synthetic
gccaagcatttaggtgacactatagccttggttgtcagtccataggtttcagagctatgctggaaacagc

SEQ ID NO: 65505 - DNA, 70 bp, Artificial Sequence
  Synthetic
gccaagcatttaggtgacactatagccggctgcttacagctccccgtttcagagctatgctggaaacagc

SEQ ID NO: 65506 - DNA, 70 bp, Artificial Sequence
  Synthetic
gccaagcatttaggtgacactataggggccaggtgtttctgttaggtttcagagctatgctggaaacagc

SEQ ID NO: 65507 - DNA, 70 bp, Artificial Sequence
  Synthetic
gccaagcatttaggtgacactataggtttatcaggaacaaacggggtttcagagctatgctggaaacagc

SEQ ID NO: 65508 - DNA, 70 bp, Artificial Sequence
  Synthetic
gccaagcatttaggtgacactatagacgggaggtgtctactgaaagtttcagagctatgctggaaacagc

SEQ ID NO: 65509 - DNA, 70 bp, Artificial Sequence
  Synthetic
gccaagcatttaggtgacactatagggcagggcacagtttctagagtttcagagctatgctggaaacagc

SEQ ID NO: 65510 - DNA, 70 bp, Artificial Sequence
  Synthetic
gccaagcatttaggtgacactataggagtagtgtcttcacttgacgtttcagagctatgctggaaacagc

SEQ ID NO: 65511 - DNA, 70 bp, Artificial Sequence
  Synthetic
gccaagcatttaggtgacactatagagtgtctgcactatttgtctgtttcagagctatgctggaaacagc

SEQ ID NO: 65512 - DNA, 70 bp, Artificial Sequence
  Synthetic
gccaagcatttaggtgacactataggcaccagtaagcagggctaggtttcagagctatgctggaaacagc

SEQ ID NO: 65513 - DNA, 70 bp, Artificial Sequence
  Synthetic
gccaagcatttaggtgacactatagctcttctagatgtgcttgccgtttcagagctatgctggaaacagc

SEQ ID NO: 65514 - DNA, 70 bp, Artificial Sequence
  Synthetic
gccaagcatttaggtgacactatagtttaatctctcttagggtaggtttcagagctatgctggaaacagc

SEQ ID NO: 65515 - DNA, 70 bp, Artificial Sequence
  Synthetic
gccaagcatttaggtgacactatagtggctcctttccatgctcatgtttcagagctatgctggaaacagc

SEQ ID NO: 65516 - DNA, 70 bp, Artificial Sequence
  Synthetic
gccaagcatttaggtgacactatagctgcaccccccaagaaaaaggtttcagagctatgctggaaacagc

SEQ ID NO: 65517 - DNA, 70 bp, Artificial Sequence
  Synthetic
gccaagcatttaggtgacactatagactcaaaattttggagtggtgtttcagagctatgctggaaacagc

SEQ ID NO: 65518 - DNA, 70 bp, Artificial Sequence
  Synthetic
gccaagcatttaggtgacactatagctacatcatcatcggcatacgtttcagagctatgctggaaacagc

SEQ ID NO: 65519 - DNA, 70 bp, Artificial Sequence
  Synthetic
gccaagcatttaggtgacactatagttggtagatcagaggaaggagtttcagagctatgctggaaacagc

SEQ ID NO: 65520 - DNA, 70 bp, Artificial Sequence
  Synthetic
gccaagcatttaggtgacactatagccaacccctccagctccctggtttcagagctatgctggaaacagc

SEQ ID NO: 65521 - DNA, 70 bp, Artificial Sequence
  Synthetic
gccaagcatttaggtgacactatagatcacagttgtcacatcagcgtttcagagctatgctggaaacagc

SEQ ID NO: 65522 - DNA, 70 bp, Artificial Sequence
  Synthetic
gccaagcatttaggtgacactatagctgaattccatgaagttctggtttcagagctatgctggaaacagc

SEQ ID NO: 65523 - DNA, 70 bp, Artificial Sequence
  Synthetic
gccaagcatttaggtgacactatagggtctttatagctgtgtctcgtttcagagctatgctggaaacagc

SEQ ID NO: 65524 - DNA, 70 bp, Artificial Sequence
  Synthetic
gccaagcatttaggtgacactatagcctgcctgcttcaggcttccgtttcagagctatgctggaaacagc

SEQ ID NO: 65525 - DNA, 70 bp, Artificial Sequence
  Synthetic
gccaagcatttaggtgacactatagggacgagatggatcggtagggtttcagagctatgctggaaacagc

SEQ ID NO: 65526 - DNA, 70 bp, Artificial Sequence
  Synthetic
gccaagcatttaggtgacactatagagcgctgcaagaagaggatggtttcagagctatgctggaaacagc

SEQ ID NO: 65527 - DNA, 70 bp, Artificial Sequence
  Synthetic
gccaagcatttaggtgacactatagacagaaaactagtccgaatcgtttcagagctatgctggaaacagc

SEQ ID NO: 65528 - DNA, 70 bp, Artificial Sequence
  Synthetic
gccaagcatttaggtgacactatagcagctgatctgtcacacaccgtttcagagctatgctggaaacagc

SEQ ID NO: 65529 - DNA, 70 bp, Artificial Sequence
  Synthetic
gccaagcatttaggtgacactatagggcatgtgcttttattaaccgtttcagagctatgctggaaacagc

SEQ ID NO: 65530 - DNA, 70 bp, Artificial Sequence
  Synthetic
gccaagcatttaggtgacactatagtggatgagaagaagaaggaggtttcagagctatgctggaaacagc

SEQ ID NO: 65531 - DNA, 70 bp, Artificial Sequence
  Synthetic
gccaagcatttaggtgacactataggacggccacgggtcttagccgtttcagagctatgctggaaacagc

SEQ ID NO: 65532 - DNA, 70 bp, Artificial Sequence
  Synthetic
gccaagcatttaggtgacactataggagctgtgcccacgatgttcgtttcagagctatgctggaaacagc

SEQ ID NO: 65533 - DNA, 70 bp, Artificial Sequence
  Synthetic
gccaagcatttaggtgacactatagaggtgggaaagactcagaccgtttcagagctatgctggaaacagc

SEQ ID NO: 65534 - DNA, 70 bp, Artificial Sequence
  Synthetic
gccaagcatttaggtgacactatagcaccttattgaagatcagccgtttcagagctatgctggaaacagc

SEQ ID NO: 65535 - DNA, 70 bp, Artificial Sequence
  Synthetic
gccaagcatttaggtgacactatagcacattcctctccttctcaggtttcagagctatgctggaaacagc

SEQ ID NO: 65536 - DNA, 70 bp, Artificial Sequence
  Synthetic
gccaagcatttaggtgacactatagtgagaatgatcacaacagccgtttcagagctatgctggaaacagc

SEQ ID NO: 65537 - DNA, 70 bp, Artificial Sequence
  Synthetic
gccaagcatttaggtgacactatagctggggtgcacagccctgatgtttcagagctatgctggaaacagc

SEQ ID NO: 65538 - DNA, 70 bp, Artificial Sequence
  Synthetic
gccaagcatttaggtgacactatagcctcactgcgtggtcaccctgtttcagagctatgctggaaacagc

SEQ ID NO: 65539 - DNA, 70 bp, Artificial Sequence
  Synthetic
gccaagcatttaggtgacactatagatggaagaagatccctaatagtttcagagctatgctggaaacagc

SEQ ID NO: 65540 - DNA, 70 bp, Artificial Sequence
  Synthetic
gccaagcatttaggtgacactatagcatttagaacagagatgtgggtttcagagctatgctggaaacagc

SEQ ID NO: 65541 - DNA, 70 bp, Artificial Sequence
  Synthetic
gccaagcatttaggtgacactataggatcgagatggagaaggtctgtttcagagctatgctggaaacagc

SEQ ID NO: 65542 - DNA, 70 bp, Artificial Sequence
  Synthetic
gccaagcatttaggtgacactatagcactgttgaaagaagcatgagtttcagagctatgctggaaacagc

SEQ ID NO: 65543 - DNA, 70 bp, Artificial Sequence
  Synthetic
gccaagcatttaggtgacactatagagacttctaagggctagaaggtttcagagctatgctggaaacagc

SEQ ID NO: 65544 - DNA, 70 bp, Artificial Sequence
  Synthetic
gccaagcatttaggtgacactatagttcctgaaaaagttcagttggtttcagagctatgctggaaacagc

SEQ ID NO: 65545 - DNA, 70 bp, Artificial Sequence
  Synthetic
gccaagcatttaggtgacactatagggaaacagatagtgtctcaggtttcagagctatgctggaaacagc

SEQ ID NO: 65546 - DNA, 70 bp, Artificial Sequence
  Synthetic
gccaagcatttaggtgacactataggggcaggtgctgcagtgaaggtttcagagctatgctggaaacagc

SEQ ID NO: 65547 - DNA, 70 bp, Artificial Sequence
  Synthetic
gccaagcatttaggtgacactatagtcccataggttgttcacatcgtttcagagctatgctggaaacagc

SEQ ID NO: 65548 - DNA, 70 bp, Artificial Sequence
  Synthetic
gccaagcatttaggtgacactatagaacccaggttctgatgtaatgtttcagagctatgctggaaacagc

SEQ ID NO: 65549 - DNA, 70 bp, Artificial Sequence
  Synthetic
gccaagcatttaggtgacactataggccaggagttcaagatcagcgtttcagagctatgctggaaacagc

SEQ ID NO: 65550 - DNA, 70 bp, Artificial Sequence
  Synthetic
gccaagcatttaggtgacactatagatgcagcctcctggagaatggtttcagagctatgctggaaacagc

SEQ ID NO: 65551 - DNA, 70 bp, Artificial Sequence
  Synthetic
gccaagcatttaggtgacactatagaaacccagtcctccttttccgtttcagagctatgctggaaacagc

SEQ ID NO: 65552 - DNA, 70 bp, Artificial Sequence
  Synthetic
gccaagcatttaggtgacactataggcaaaaggcctgttctgagtgtttcagagctatgctggaaacagc

SEQ ID NO: 65553 - DNA, 70 bp, Artificial Sequence
  Synthetic
gccaagcatttaggtgacactatagcccaccagaaggtggacttagtttcagagctatgctggaaacagc

SEQ ID NO: 65554 - DNA, 70 bp, Artificial Sequence
  Synthetic
gccaagcatttaggtgacactatagccccaccagaaggtggacttgtttcagagctatgctggaaacagc

SEQ ID NO: 65555 - DNA, 70 bp, Artificial Sequence
  Synthetic
gccaagcatttaggtgacactatagcaggtcgaactctggctctcgtttcagagctatgctggaaacagc

SEQ ID NO: 65556 - DNA, 70 bp, Artificial Sequence
  Synthetic
gccaagcatttaggtgacactatagccccatcgaaaccaaaggacgtttcagagctatgctggaaacagc

SEQ ID NO: 65557 - DNA, 70 bp, Artificial Sequence
  Synthetic
gccaagcatttaggtgacactatagcagcaagctcagtcactccggtttcagagctatgctggaaacagc

SEQ ID NO: 65558 - DNA, 70 bp, Artificial Sequence
  Synthetic
gccaagcatttaggtgacactatagctggacatgaatgactgagcgtttcagagctatgctggaaacagc

SEQ ID NO: 65559 - DNA, 70 bp, Artificial Sequence
  Synthetic
gccaagcatttaggtgacactatagcacccaccaaagctcagggcgtttcagagctatgctggaaacagc

SEQ ID NO: 65560 - DNA, 70 bp, Artificial Sequence
  Synthetic
gccaagcatttaggtgacactataggtgaagacatgctcaactatgtttcagagctatgctggaaacagc

SEQ ID NO: 65561 - DNA, 70 bp, Artificial Sequence
  Synthetic
gccaagcatttaggtgacactatagacgagatgaaaactgggatagtttcagagctatgctggaaacagc

SEQ ID NO: 65562 - DNA, 70 bp, Artificial Sequence
  Synthetic
gccaagcatttaggtgacactatagttaggttttgatacggaagggtttcagagctatgctggaaacagc

SEQ ID NO: 65563 - DNA, 70 bp, Artificial Sequence
  Synthetic
gccaagcatttaggtgacactatagcaggtagaccagtgacatgggtttcagagctatgctggaaacagc

SEQ ID NO: 65564 - DNA, 70 bp, Artificial Sequence
  Synthetic
gccaagcatttaggtgacactatagggcgggtcctgctggcctaggtttcagagctatgctggaaacagc

SEQ ID NO: 65565 - DNA, 70 bp, Artificial Sequence
  Synthetic
gccaagcatttaggtgacactataggaagtacagaccaacagagagtttcagagctatgctggaaacagc

SEQ ID NO: 65566 - DNA, 70 bp, Artificial Sequence
  Synthetic
gccaagcatttaggtgacactatagtgagaccaagcaaaggctgtgtttcagagctatgctggaaacagc

SEQ ID NO: 65567 - DNA, 70 bp, Artificial Sequence
  Synthetic
gccaagcatttaggtgacactatagctatctccgcgctctactgcgtttcagagctatgctggaaacagc

SEQ ID NO: 65568 - DNA, 70 bp, Artificial Sequence
  Synthetic
gccaagcatttaggtgacactatagttgggctgtaattgctaaaagtttcagagctatgctggaaacagc

SEQ ID NO: 65569 - DNA, 70 bp, Artificial Sequence
  Synthetic
gccaagcatttaggtgacactataggctgcaagacaggcttcttagtttcagagctatgctggaaacagc

SEQ ID NO: 65570 - DNA, 70 bp, Artificial Sequence
  Synthetic
gccaagcatttaggtgacactatagtctgtgatctgcaagtgctggtttcagagctatgctggaaacagc

SEQ ID NO: 65571 - DNA, 70 bp, Artificial Sequence
  Synthetic
gccaagcatttaggtgacactatagagcaagagatagcaagtgttgtttcagagctatgctggaaacagc

SEQ ID NO: 65572 - DNA, 70 bp, Artificial Sequence
  Synthetic
gccaagcatttaggtgacactatagcaccccgtcatctggctcaggtttcagagctatgctggaaacagc

SEQ ID NO: 65573 - DNA, 70 bp, Artificial Sequence
  Synthetic
gccaagcatttaggtgacactataggcagacagttgagtctacaggtttcagagctatgctggaaacagc

SEQ ID NO: 65574 - DNA, 70 bp, Artificial Sequence
  Synthetic
gccaagcatttaggtgacactatagcatcattataaggacgtctcgtttcagagctatgctggaaacagc

SEQ ID NO: 65575 - DNA, 70 bp, Artificial Sequence
  Synthetic
gccaagcatttaggtgacactataggcgcaattactactatgacggtttcagagctatgctggaaacagc

SEQ ID NO: 65576 - DNA, 70 bp, Artificial Sequence
  Synthetic
gccaagcatttaggtgacactataggccaaggggaacagctgacggtttcagagctatgctggaaacagc

SEQ ID NO: 65577 - DNA, 70 bp, Artificial Sequence
  Synthetic
gccaagcatttaggtgacactataggcccaggcccagccttagccgtttcagagctatgctggaaacagc

SEQ ID NO: 65578 - DNA, 70 bp, Artificial Sequence
  Synthetic
gccaagcatttaggtgacactatagtctcagagtggggtatcagtgtttcagagctatgctggaaacagc

SEQ ID NO: 65579 - DNA, 70 bp, Artificial Sequence
  Synthetic
gccaagcatttaggtgacactatagtaagaagcttggacttgtttgtttcagagctatgctggaaacagc

SEQ ID NO: 65580 - DNA, 70 bp, Artificial Sequence
  Synthetic
gccaagcatttaggtgacactatagtgaagagctaatctgaaaaggtttcagagctatgctggaaacagc

SEQ ID NO: 65581 - DNA, 70 bp, Artificial Sequence
  Synthetic
gccaagcatttaggtgacactataggatggcgttagtcagagaacgtttcagagctatgctggaaacagc

SEQ ID NO: 65582 - DNA, 70 bp, Artificial Sequence
  Synthetic
gccaagcatttaggtgacactatagcttgcggaggtgggcgtggcgtttcagagctatgctggaaacagc

SEQ ID NO: 65583 - DNA, 70 bp, Artificial Sequence
  Synthetic
gccaagcatttaggtgacactatagggaatggagacacagtctcagtttcagagctatgctggaaacagc

SEQ ID NO: 65584 - DNA, 70 bp, Artificial Sequence
  Synthetic
gccaagcatttaggtgacactatagagaagttttttgctgtttccgtttcagagctatgctggaaacagc

SEQ ID NO: 65585 - DNA, 70 bp, Artificial Sequence
  Synthetic
gccaagcatttaggtgacactatagaggatacttttgggcaacaggtttcagagctatgctggaaacagc

SEQ ID NO: 65586 - DNA, 70 bp, Artificial Sequence
  Synthetic
gccaagcatttaggtgacactatagaagtcagtcttcattgtaacgtttcagagctatgctggaaacagc

SEQ ID NO: 65587 - DNA, 70 bp, Artificial Sequence
  Synthetic
gccaagcatttaggtgacactatagtccattcgcaggaagctcacgtttcagagctatgctggaaacagc

SEQ ID NO: 65588 - DNA, 70 bp, Artificial Sequence
  Synthetic
gccaagcatttaggtgacactatagtacatgtcccagaacggtcagtttcagagctatgctggaaacagc

SEQ ID NO: 65589 - DNA, 70 bp, Artificial Sequence
  Synthetic
gccaagcatttaggtgacactataggacctggccctggctcagaagtttcagagctatgctggaaacagc

SEQ ID NO: 65590 - DNA, 70 bp, Artificial Sequence
  Synthetic
gccaagcatttaggtgacactatagggcatctgcttagttcagaggtttcagagctatgctggaaacagc

SEQ ID NO: 65591 - DNA, 70 bp, Artificial Sequence
  Synthetic
gccaagcatttaggtgacactatagtgggccaccccccacatagagtttcagagctatgctggaaacagc

SEQ ID NO: 65592 - DNA, 70 bp, Artificial Sequence
  Synthetic
gccaagcatttaggtgacactataggtgtgccccagtgggttagggtttcagagctatgctggaaacagc

SEQ ID NO: 65593 - DNA, 70 bp, Artificial Sequence
  Synthetic
gccaagcatttaggtgacactatagttattacacacatcagactggtttcagagctatgctggaaacagc

SEQ ID NO: 65594 - DNA, 70 bp, Artificial Sequence
  Synthetic
gccaagcatttaggtgacactatagggtggggccagcgtcacacggtttcagagctatgctggaaacagc

SEQ ID NO: 65595 - DNA, 70 bp, Artificial Sequence
  Synthetic
gccaagcatttaggtgacactatagtctgatgctgggtgggctaggtttcagagctatgctggaaacagc

SEQ ID NO: 65596 - DNA, 70 bp, Artificial Sequence
  Synthetic
gccaagcatttaggtgacactatagccccagggctaccagtcgcagtttcagagctatgctggaaacagc

SEQ ID NO: 65597 - DNA, 70 bp, Artificial Sequence
  Synthetic
gccaagcatttaggtgacactatagccctgcctcggcacagccgtgtttcagagctatgctggaaacagc

SEQ ID NO: 65598 - DNA, 70 bp, Artificial Sequence
  Synthetic
gccaagcatttaggtgacactataggccgccccctgtgtactgaggtttcagagctatgctggaaacagc

SEQ ID NO: 65599 - DNA, 70 bp, Artificial Sequence
  Synthetic
gccaagcatttaggtgacactataggagtggggtcaacgtaattcgtttcagagctatgctggaaacagc

SEQ ID NO: 65600 - DNA, 70 bp, Artificial Sequence
  Synthetic
gccaagcatttaggtgacactatagtgtgcctgccagccgctagtgtttcagagctatgctggaaacagc

SEQ ID NO: 65601 - DNA, 70 bp, Artificial Sequence
  Synthetic
gccaagcatttaggtgacactatagtgtcaggcatcatagcaagcgtttcagagctatgctggaaacagc

SEQ ID NO: 65602 - DNA, 70 bp, Artificial Sequence
  Synthetic
gccaagcatttaggtgacactatagggagcaaccatcagggtaacgtttcagagctatgctggaaacagc

SEQ ID NO: 65603 - DNA, 70 bp, Artificial Sequence
  Synthetic
gccaagcatttaggtgacactatagtctttctgtaaagtccagtggtttcagagctatgctggaaacagc

SEQ ID NO: 65604 - DNA, 70 bp, Artificial Sequence
  Synthetic
gccaagcatttaggtgacactatagctcagtcatgtttttgccaggtttcagagctatgctggaaacagc

SEQ ID NO: 65605 - DNA, 70 bp, Artificial Sequence
  Synthetic
gccaagcatttaggtgacactatagcctgggctttcatgagatacgtttcagagctatgctggaaacagc

SEQ ID NO: 65606 - DNA, 70 bp, Artificial Sequence
  Synthetic
gccaagcatttaggtgacactatagaggaggagaatgatgggcatgtttcagagctatgctggaaacagc

SEQ ID NO: 65607 - DNA, 70 bp, Artificial Sequence
  Synthetic
gccaagcatttaggtgacactatagggttcgttacttgaagcagagtttcagagctatgctggaaacagc

SEQ ID NO: 65608 - DNA, 70 bp, Artificial Sequence
  Synthetic
gccaagcatttaggtgacactataggtcgggggtggggctctagggtttcagagctatgctggaaacagc

SEQ ID NO: 65609 - DNA, 70 bp, Artificial Sequence
  Synthetic
gccaagcatttaggtgacactatagacaacccacacccaaggggagtttcagagctatgctggaaacagc

SEQ ID NO: 65610 - DNA, 70 bp, Artificial Sequence
  Synthetic
gccaagcatttaggtgacactatagattatcaggtagaggaagaagtttcagagctatgctggaaacagc

SEQ ID NO: 65611 - DNA, 70 bp, Artificial Sequence
  Synthetic
gccaagcatttaggtgacactatagggtgtggaaaccatctgttggtttcagagctatgctggaaacagc

SEQ ID NO: 65612 - DNA, 70 bp, Artificial Sequence
  Synthetic
gccaagcatttaggtgacactataggtttgctttctctagtccatgtttcagagctatgctggaaacagc

SEQ ID NO: 65613 - DNA, 70 bp, Artificial Sequence
  Synthetic
gccaagcatttaggtgacactatagggggcagggcaccagtgaacgtttcagagctatgctggaaacagc

SEQ ID NO: 65614 - DNA, 70 bp, Artificial Sequence
  Synthetic
gccaagcatttaggtgacactatagaatctgattggtaaaggaaggtttcagagctatgctggaaacagc

SEQ ID NO: 65615 - DNA, 70 bp, Artificial Sequence
  Synthetic
gccaagcatttaggtgacactatagacagaggagttgttcagagcgtttcagagctatgctggaaacagc

SEQ ID NO: 65616 - DNA, 70 bp, Artificial Sequence
  Synthetic
gccaagcatttaggtgacactatagttctccaatcagatgtagtcgtttcagagctatgctggaaacagc

SEQ ID NO: 65617 - DNA, 70 bp, Artificial Sequence
  Synthetic
gccaagcatttaggtgacactatagggaggtattccacctcctacgtttcagagctatgctggaaacagc

SEQ ID NO: 65618 - DNA, 70 bp, Artificial Sequence
  Synthetic
gccaagcatttaggtgacactatagtgcagctgagcagggagcaggtttcagagctatgctggaaacagc

SEQ ID NO: 65619 - DNA, 70 bp, Artificial Sequence
  Synthetic
gccaagcatttaggtgacactatagaagggcctgattctagacatgtttcagagctatgctggaaacagc

SEQ ID NO: 65620 - DNA, 70 bp, Artificial Sequence
  Synthetic
gccaagcatttaggtgacactatagcccctctagcctttcttaacgtttcagagctatgctggaaacagc

SEQ ID NO: 65621 - DNA, 70 bp, Artificial Sequence
  Synthetic
gccaagcatttaggtgacactatagtgctggccgtcaagaagtaagtttcagagctatgctggaaacagc

SEQ ID NO: 65622 - DNA, 70 bp, Artificial Sequence
  Synthetic
gccaagcatttaggtgacactatagattttggaggcattatggtggtttcagagctatgctggaaacagc

SEQ ID NO: 65623 - DNA, 70 bp, Artificial Sequence
  Synthetic
gccaagcatttaggtgacactatagctcgctcagactgtgccactgtttcagagctatgctggaaacagc

SEQ ID NO: 65624 - DNA, 70 bp, Artificial Sequence
  Synthetic
gccaagcatttaggtgacactataggccctggttgctagtttcgcgtttcagagctatgctggaaacagc

SEQ ID NO: 65625 - DNA, 70 bp, Artificial Sequence
  Synthetic
gccaagcatttaggtgacactataggcagctgggcagctggttacgtttcagagctatgctggaaacagc

SEQ ID NO: 65626 - DNA, 70 bp, Artificial Sequence
  Synthetic
gccaagcatttaggtgacactatagaaggacagcaagtatgtagagtttcagagctatgctggaaacagc

SEQ ID NO: 65627 - DNA, 70 bp, Artificial Sequence
  Synthetic
gccaagcatttaggtgacactataggggggtggctggcatctatcgtttcagagctatgctggaaacagc

SEQ ID NO: 65628 - DNA, 70 bp, Artificial Sequence
  Synthetic
gccaagcatttaggtgacactatagggcgaagggtcagggctccggtttcagagctatgctggaaacagc

SEQ ID NO: 65629 - DNA, 70 bp, Artificial Sequence
  Synthetic
gccaagcatttaggtgacactataggcacactttgctggaatcctgtttcagagctatgctggaaacagc

SEQ ID NO: 65630 - DNA, 70 bp, Artificial Sequence
  Synthetic
gccaagcatttaggtgacactatagcctccctggaggtgacctgagtttcagagctatgctggaaacagc

SEQ ID NO: 65631 - DNA, 70 bp, Artificial Sequence
  Synthetic
gccaagcatttaggtgacactatagctgtctacttgttcttgcccgtttcagagctatgctggaaacagc

SEQ ID NO: 65632 - DNA, 70 bp, Artificial Sequence
  Synthetic
gccaagcatttaggtgacactataggaaagagaactccgagtgaggtttcagagctatgctggaaacagc

SEQ ID NO: 65633 - DNA, 70 bp, Artificial Sequence
  Synthetic
gccaagcatttaggtgacactatagaagtggcacgtgctctgtgagtttcagagctatgctggaaacagc

SEQ ID NO: 65634 - DNA, 70 bp, Artificial Sequence
  Synthetic
gccaagcatttaggtgacactatagtggggtgggagtcagggcgcgtttcagagctatgctggaaacagc

SEQ ID NO: 65635 - DNA, 70 bp, Artificial Sequence
  Synthetic
gccaagcatttaggtgacactatagcgtgaatgaaatcacaaccggtttcagagctatgctggaaacagc

SEQ ID NO: 65636 - DNA, 70 bp, Artificial Sequence
  Synthetic
gccaagcatttaggtgacactatagcaccagctgaaggcctgagtgtttcagagctatgctggaaacagc

SEQ ID NO: 65637 - DNA, 70 bp, Artificial Sequence
  Synthetic
gccaagcatttaggtgacactataggcatgtggtgcattcaggaggtttcagagctatgctggaaacagc

SEQ ID NO: 65638 - DNA, 70 bp, Artificial Sequence
  Synthetic
gccaagcatttaggtgacactatagtgcacactggcattccctgggtttcagagctatgctggaaacagc

SEQ ID NO: 65639 - DNA, 70 bp, Artificial Sequence
  Synthetic
gccaagcatttaggtgacactatagggcttggtggggctacgtccgtttcagagctatgctggaaacagc

SEQ ID NO: 65640 - DNA, 70 bp, Artificial Sequence
  Synthetic
gccaagcatttaggtgacactatagcagtggaatttgggctcattgtttcagagctatgctggaaacagc

SEQ ID NO: 65641 - DNA, 70 bp, Artificial Sequence
  Synthetic
gccaagcatttaggtgacactatagtgaggccttcatgtcagtgcgtttcagagctatgctggaaacagc

SEQ ID NO: 65642 - DNA, 70 bp, Artificial Sequence
  Synthetic
gccaagcatttaggtgacactatagtcaatggccaagcagaagctgtttcagagctatgctggaaacagc

SEQ ID NO: 65643 - DNA, 70 bp, Artificial Sequence
  Synthetic
gccaagcatttaggtgacactataggggaaaatgtaggctctaaagtttcagagctatgctggaaacagc

SEQ ID NO: 65644 - DNA, 70 bp, Artificial Sequence
  Synthetic
gccaagcatttaggtgacactatagctgggctggggcagtgtcaggtttcagagctatgctggaaacagc

SEQ ID NO: 65645 - DNA, 70 bp, Artificial Sequence
  Synthetic
gccaagcatttaggtgacactatagttgggtcctgatgggtctcagtttcagagctatgctggaaacagc

SEQ ID NO: 65646 - DNA, 70 bp, Artificial Sequence
  Synthetic
gccaagcatttaggtgacactatagggtccagtccactccctcaggtttcagagctatgctggaaacagc

SEQ ID NO: 65647 - DNA, 70 bp, Artificial Sequence
  Synthetic
gccaagcatttaggtgacactatagctgggccttgctgcttcacagtttcagagctatgctggaaacagc

SEQ ID NO: 65648 - DNA, 70 bp, Artificial Sequence
  Synthetic
gccaagcatttaggtgacactatagtacacctggatgaatcttttgtttcagagctatgctggaaacagc

SEQ ID NO: 65649 - DNA, 70 bp, Artificial Sequence
  Synthetic
gccaagcatttaggtgacactataggcactgaagtacattttgctgtttcagagctatgctggaaacagc

SEQ ID NO: 65650 - DNA, 70 bp, Artificial Sequence
  Synthetic
gccaagcatttaggtgacactatagaaatcaacagtgcgtgtctggtttcagagctatgctggaaacagc

SEQ ID NO: 65651 - DNA, 70 bp, Artificial Sequence
  Synthetic
gccaagcatttaggtgacactatagaatctcataaatacaggcaggtttcagagctatgctggaaacagc

SEQ ID NO: 65652 - DNA, 70 bp, Artificial Sequence
  Synthetic
gccaagcatttaggtgacactatagtttatggctttcctaaaccagtttcagagctatgctggaaacagc

SEQ ID NO: 65653 - DNA, 70 bp, Artificial Sequence
  Synthetic
gccaagcatttaggtgacactatagttgtaagcggcaaggtcttagtttcagagctatgctggaaacagc

SEQ ID NO: 65654 - DNA, 70 bp, Artificial Sequence
  Synthetic
gccaagcatttaggtgacactatagagcctgaccccagggtaggagtttcagagctatgctggaaacagc

SEQ ID NO: 65655 - DNA, 70 bp, Artificial Sequence
  Synthetic
gccaagcatttaggtgacactatagagcgtggtgacagcaccgtagtttcagagctatgctggaaacagc

SEQ ID NO: 65656 - DNA, 70 bp, Artificial Sequence
  Synthetic
gccaagcatttaggtgacactatagcatttggctcagaaatgcctgtttcagagctatgctggaaacagc

SEQ ID NO: 65657 - DNA, 70 bp, Artificial Sequence
  Synthetic
gccaagcatttaggtgacactatagttctgaattcaggtgtaccggtttcagagctatgctggaaacagc

SEQ ID NO: 65658 - DNA, 70 bp, Artificial Sequence
  Synthetic
gccaagcatttaggtgacactatagagattcctttgttggactaagtttcagagctatgctggaaacagc

SEQ ID NO: 65659 - DNA, 70 bp, Artificial Sequence
  Synthetic
gccaagcatttaggtgacactataggccctgttaaaggctctttagtttcagagctatgctggaaacagc

SEQ ID NO: 65660 - DNA, 70 bp, Artificial Sequence
  Synthetic
gccaagcatttaggtgacactatagttaatgggcaaacgggatgcgtttcagagctatgctggaaacagc

SEQ ID NO: 65661 - DNA, 70 bp, Artificial Sequence
  Synthetic
gccaagcatttaggtgacactataggtatcccccgagagcagaatgtttcagagctatgctggaaacagc

SEQ ID NO: 65662 - DNA, 70 bp, Artificial Sequence
  Synthetic
gccaagcatttaggtgacactataggcgaagctgtgcatttatgcgtttcagagctatgctggaaacagc

SEQ ID NO: 65663 - DNA, 70 bp, Artificial Sequence
  Synthetic
gccaagcatttaggtgacactatagggggcttttactctgaacctgtttcagagctatgctggaaacagc

SEQ ID NO: 65664 - DNA, 70 bp, Artificial Sequence
  Synthetic
gccaagcatttaggtgacactataggatgagctgattgcaaagctgtttcagagctatgctggaaacagc

SEQ ID NO: 65665 - DNA, 70 bp, Artificial Sequence
  Synthetic
gccaagcatttaggtgacactatagttcatcctcagaagcaggtagtttcagagctatgctggaaacagc

SEQ ID NO: 65666 - DNA, 70 bp, Artificial Sequence
  Synthetic
gccaagcatttaggtgacactataggagttagcttttccccatttgtttcagagctatgctggaaacagc

SEQ ID NO: 65667 - DNA, 70 bp, Artificial Sequence
  Synthetic
gccaagcatttaggtgacactatagaggtcagatcttctccatctgtttcagagctatgctggaaacagc

SEQ ID NO: 65668 - DNA, 70 bp, Artificial Sequence
  Synthetic
gccaagcatttaggtgacactatagagacgtgaatcacatcctcggtttcagagctatgctggaaacagc

SEQ ID NO: 65669 - DNA, 70 bp, Artificial Sequence
  Synthetic
gccaagcatttaggtgacactatagctcctccaatgtgctctcctgtttcagagctatgctggaaacagc

SEQ ID NO: 65670 - DNA, 70 bp, Artificial Sequence
  Synthetic
gccaagcatttaggtgacactatagtgctgcctcaatgacaggtggtttcagagctatgctggaaacagc

SEQ ID NO: 65671 - DNA, 70 bp, Artificial Sequence
  Synthetic
gccaagcatttaggtgacactatagttcaacatgagttttggtgggtttcagagctatgctggaaacagc

SEQ ID NO: 65672 - DNA, 70 bp, Artificial Sequence
  Synthetic
gccaagcatttaggtgacactatagaagctcaccctatacctctggtttcagagctatgctggaaacagc

SEQ ID NO: 65673 - DNA, 70 bp, Artificial Sequence
  Synthetic
gccaagcatttaggtgacactataggagaaaggaaccgagcttgtgtttcagagctatgctggaaacagc

SEQ ID NO: 65674 - DNA, 70 bp, Artificial Sequence
  Synthetic
gccaagcatttaggtgacactataggcacagcaaaagcccctcctgtttcagagctatgctggaaacagc

SEQ ID NO: 65675 - DNA, 70 bp, Artificial Sequence
  Synthetic
gccaagcatttaggtgacactatagacacacacaaatactgctcagtttcagagctatgctggaaacagc

SEQ ID NO: 65676 - DNA, 70 bp, Artificial Sequence
  Synthetic
gccaagcatttaggtgacactatagggatacatcactaaaggctagtttcagagctatgctggaaacagc

SEQ ID NO: 65677 - DNA, 70 bp, Artificial Sequence
  Synthetic
gccaagcatttaggtgacactatagtcagcttcaagacgcgtcccgtttcagagctatgctggaaacagc

SEQ ID NO: 65678 - DNA, 70 bp, Artificial Sequence
  Synthetic
gccaagcatttaggtgacactatagctgctaacgctcacctcagcgtttcagagctatgctggaaacagc

SEQ ID NO: 65679 - DNA, 70 bp, Artificial Sequence
  Synthetic
gccaagcatttaggtgacactataggcatcctgaagctgctggatgtttcagagctatgctggaaacagc

SEQ ID NO: 65680 - DNA, 70 bp, Artificial Sequence
  Synthetic
gccaagcatttaggtgacactataggacttggactctgatgaatggtttcagagctatgctggaaacagc

SEQ ID NO: 65681 - DNA, 70 bp, Artificial Sequence
  Synthetic
gccaagcatttaggtgacactataggtggctcaggtgaagtagtggtttcagagctatgctggaaacagc

SEQ ID NO: 65682 - DNA, 70 bp, Artificial Sequence
  Synthetic
gccaagcatttaggtgacactatagactacaacccaaacatatgagtttcagagctatgctggaaacagc

SEQ ID NO: 65683 - DNA, 70 bp, Artificial Sequence
  Synthetic
gccaagcatttaggtgacactatagatatgagggaagccgttagagtttcagagctatgctggaaacagc

SEQ ID NO: 65684 - DNA, 70 bp, Artificial Sequence
  Synthetic
gccaagcatttaggtgacactatagcctttccgtgtgttatttctgtttcagagctatgctggaaacagc

SEQ ID NO: 65685 - DNA, 70 bp, Artificial Sequence
  Synthetic
gccaagcatttaggtgacactatagagtaagcaagtctttaacccgtttcagagctatgctggaaacagc

SEQ ID NO: 65686 - DNA, 70 bp, Artificial Sequence
  Synthetic
gccaagcatttaggtgacactatagaaaacagtcatcagtatggtgtttcagagctatgctggaaacagc

SEQ ID NO: 65687 - DNA, 70 bp, Artificial Sequence
  Synthetic
gccaagcatttaggtgacactatagagcaagatcaccaaatcttagtttcagagctatgctggaaacagc

SEQ ID NO: 65688 - DNA, 70 bp, Artificial Sequence
  Synthetic
gccaagcatttaggtgacactatagtcaatgtcgtctcactttctgtttcagagctatgctggaaacagc

SEQ ID NO: 65689 - DNA, 70 bp, Artificial Sequence
  Synthetic
gccaagcatttaggtgacactatagaagcctcgaatgggcttctggtttcagagctatgctggaaacagc

SEQ ID NO: 65690 - DNA, 70 bp, Artificial Sequence
  Synthetic
gccaagcatttaggtgacactataggagaggcctgaaaatgtgacgtttcagagctatgctggaaacagc

SEQ ID NO: 65691 - DNA, 70 bp, Artificial Sequence
  Synthetic
gccaagcatttaggtgacactatagggagaacacaaggatgggcagtttcagagctatgctggaaacagc

SEQ ID NO: 65692 - DNA, 70 bp, Artificial Sequence
  Synthetic
gccaagcatttaggtgacactatagccttccctttcagactgagagtttcagagctatgctggaaacagc

SEQ ID NO: 65693 - DNA, 70 bp, Artificial Sequence
  Synthetic
gccaagcatttaggtgacactatagagcccctcgggagtcgtcaggtttcagagctatgctggaaacagc

SEQ ID NO: 65694 - DNA, 70 bp, Artificial Sequence
  Synthetic
gccaagcatttaggtgacactataggcgtcctcctgtgtcacttagtttcagagctatgctggaaacagc

SEQ ID NO: 65695 - DNA, 70 bp, Artificial Sequence
  Synthetic
gccaagcatttaggtgacactatagagtggagtggtcacttcagagtttcagagctatgctggaaacagc

SEQ ID NO: 65696 - DNA, 70 bp, Artificial Sequence
  Synthetic
gccaagcatttaggtgacactatagagaaacctggttctagctgcgtttcagagctatgctggaaacagc

SEQ ID NO: 65697 - DNA, 70 bp, Artificial Sequence
  Synthetic
gccaagcatttaggtgacactatagtgtaaccttcttctggtgacgtttcagagctatgctggaaacagc

SEQ ID NO: 65698 - DNA, 70 bp, Artificial Sequence
  Synthetic
gccaagcatttaggtgacactatagttgtgatattctggaggagggtttcagagctatgctggaaacagc

SEQ ID NO: 65699 - DNA, 70 bp, Artificial Sequence
  Synthetic
gccaagcatttaggtgacactatagcaggtggagcatcacggagcgtttcagagctatgctggaaacagc

SEQ ID NO: 65700 - DNA, 70 bp, Artificial Sequence
  Synthetic
gccaagcatttaggtgacactatagaaggggccactgactcagaggtttcagagctatgctggaaacagc

SEQ ID NO: 65701 - DNA, 70 bp, Artificial Sequence
  Synthetic
gccaagcatttaggtgacactataggcaactcagctctttgcaaggtttcagagctatgctggaaacagc

SEQ ID NO: 65702 - DNA, 70 bp, Artificial Sequence
  Synthetic
gccaagcatttaggtgacactatagcagcgttttctgaagaagtggtttcagagctatgctggaaacagc

SEQ ID NO: 65703 - DNA, 70 bp, Artificial Sequence
  Synthetic
gccaagcatttaggtgacactatagtttccttctcagctcaggaggtttcagagctatgctggaaacagc

SEQ ID NO: 65704 - DNA, 70 bp, Artificial Sequence
  Synthetic
gccaagcatttaggtgacactatagtttttggacccgattaatgagtttcagagctatgctggaaacagc

SEQ ID NO: 65705 - DNA, 70 bp, Artificial Sequence
  Synthetic
gccaagcatttaggtgacactatagtcttcatgttttctcttcaggtttcagagctatgctggaaacagc

SEQ ID NO: 65706 - DNA, 70 bp, Artificial Sequence
  Synthetic
gccaagcatttaggtgacactatagccagaaggacctgaacaacagtttcagagctatgctggaaacagc

SEQ ID NO: 65707 - DNA, 70 bp, Artificial Sequence
  Synthetic
gccaagcatttaggtgacactatagatgtagccagccggtctttggtttcagagctatgctggaaacagc

SEQ ID NO: 65708 - DNA, 70 bp, Artificial Sequence
  Synthetic
gccaagcatttaggtgacactatagcggcagatcatcagttagaggtttcagagctatgctggaaacagc

SEQ ID NO: 65709 - DNA, 70 bp, Artificial Sequence
  Synthetic
gccaagcatttaggtgacactatagaaggcctggggtgggatcaggtttcagagctatgctggaaacagc

SEQ ID NO: 65710 - DNA, 70 bp, Artificial Sequence
  Synthetic
gccaagcatttaggtgacactataggatgcccaggcagatcatgtgtttcagagctatgctggaaacagc

SEQ ID NO: 65711 - DNA, 70 bp, Artificial Sequence
  Synthetic
gccaagcatttaggtgacactatagccccaggtcttaggaaagacgtttcagagctatgctggaaacagc

SEQ ID NO: 65712 - DNA, 70 bp, Artificial Sequence
  Synthetic
gccaagcatttaggtgacactatagtggagccggccctcggtgatgtttcagagctatgctggaaacagc

SEQ ID NO: 65713 - DNA, 70 bp, Artificial Sequence
  Synthetic
gccaagcatttaggtgacactatagagccaccacattccttagtggtttcagagctatgctggaaacagc

SEQ ID NO: 65714 - DNA, 70 bp, Artificial Sequence
  Synthetic
gccaagcatttaggtgacactatagcgaatgttcaatgcagagaagtttcagagctatgctggaaacagc

SEQ ID NO: 65715 - DNA, 70 bp, Artificial Sequence
  Synthetic
gccaagcatttaggtgacactatagaaatgtggaaagggtggctggtttcagagctatgctggaaacagc

SEQ ID NO: 65716 - DNA, 70 bp, Artificial Sequence
  Synthetic
gccaagcatttaggtgacactatagagagtttcacagcctcttgcgtttcagagctatgctggaaacagc

SEQ ID NO: 65717 - DNA, 70 bp, Artificial Sequence
  Synthetic
gccaagcatttaggtgacactataggctttggtttggctgcagtggtttcagagctatgctggaaacagc

SEQ ID NO: 65718 - DNA, 70 bp, Artificial Sequence
  Synthetic
gccaagcatttaggtgacactatagtaaacattagactccacgaagtttcagagctatgctggaaacagc

SEQ ID NO: 65719 - DNA, 70 bp, Artificial Sequence
  Synthetic
gccaagcatttaggtgacactataggctctgcagtgtgaactcatgtttcagagctatgctggaaacagc

SEQ ID NO: 65720 - DNA, 70 bp, Artificial Sequence
  Synthetic
gccaagcatttaggtgacactatagacacaaaaattagctgggcagtttcagagctatgctggaaacagc

SEQ ID NO: 65721 - DNA, 70 bp, Artificial Sequence
  Synthetic
gccaagcatttaggtgacactatagcatcatgctacgctcagtgagtttcagagctatgctggaaacagc

SEQ ID NO: 65722 - DNA, 70 bp, Artificial Sequence
  Synthetic
gccaagcatttaggtgacactatagcttggagccaggtctacggcgtttcagagctatgctggaaacagc

SEQ ID NO: 65723 - DNA, 70 bp, Artificial Sequence
  Synthetic
gccaagcatttaggtgacactataggcagaagcaatgtctaccttgtttcagagctatgctggaaacagc

SEQ ID NO: 65724 - DNA, 70 bp, Artificial Sequence
  Synthetic
gccaagcatttaggtgacactatagagtgtgaattaagatgccgagtttcagagctatgctggaaacagc

SEQ ID NO: 65725 - DNA, 70 bp, Artificial Sequence
  Synthetic
gccaagcatttaggtgacactatagataagacatgtgtgacccatgtttcagagctatgctggaaacagc

SEQ ID NO: 65726 - DNA, 70 bp, Artificial Sequence
  Synthetic
gccaagcatttaggtgacactatagggctggagtcagctacctccgtttcagagctatgctggaaacagc

SEQ ID NO: 65727 - DNA, 70 bp, Artificial Sequence
  Synthetic
gccaagcatttaggtgacactatagtcttcccacttctattcctggtttcagagctatgctggaaacagc

SEQ ID NO: 65728 - DNA, 70 bp, Artificial Sequence
  Synthetic
gccaagcatttaggtgacactatagtctcatctgtagtcctccttgtttcagagctatgctggaaacagc

SEQ ID NO: 65729 - DNA, 70 bp, Artificial Sequence
  Synthetic
gccaagcatttaggtgacactatagtctcgctgcgttccttctgagtttcagagctatgctggaaacagc

SEQ ID NO: 65730 - DNA, 70 bp, Artificial Sequence
  Synthetic
gccaagcatttaggtgacactataggtctgagaaggctttcattcgtttcagagctatgctggaaacagc

SEQ ID NO: 65731 - DNA, 70 bp, Artificial Sequence
  Synthetic
gccaagcatttaggtgacactatagaagcttgcccagctctaggagtttcagagctatgctggaaacagc

SEQ ID NO: 65732 - DNA, 70 bp, Artificial Sequence
  Synthetic
gccaagcatttaggtgacactatagcagcagcggctgatggactggtttcagagctatgctggaaacagc

SEQ ID NO: 65733 - DNA, 70 bp, Artificial Sequence
  Synthetic
gccaagcatttaggtgacactatagcctagatgtgcagtgcgagcgtttcagagctatgctggaaacagc

SEQ ID NO: 65734 - DNA, 70 bp, Artificial Sequence
  Synthetic
gccaagcatttaggtgacactatagtggcactatatcctaactgtgtttcagagctatgctggaaacagc

SEQ ID NO: 65735 - DNA, 70 bp, Artificial Sequence
  Synthetic
gccaagcatttaggtgacactatagtgtctacctgtccacctgcagtttcagagctatgctggaaacagc

SEQ ID NO: 65736 - DNA, 70 bp, Artificial Sequence
  Synthetic
gccaagcatttaggtgacactatagtcatgtcgctttaggtcagcgtttcagagctatgctggaaacagc

SEQ ID NO: 65737 - DNA, 70 bp, Artificial Sequence
  Synthetic
gccaagcatttaggtgacactatagagccacagattcagtcaattgtttcagagctatgctggaaacagc

SEQ ID NO: 65738 - DNA, 70 bp, Artificial Sequence
  Synthetic
gccaagcatttaggtgacactatagaaggaaggcacatcatggctgtttcagagctatgctggaaacagc

SEQ ID NO: 65739 - DNA, 70 bp, Artificial Sequence
  Synthetic
gccaagcatttaggtgacactatagcagtacctcaagatcatggcgtttcagagctatgctggaaacagc

SEQ ID NO: 65740 - DNA, 70 bp, Artificial Sequence
  Synthetic
gccaagcatttaggtgacactataggattctaagtcttctggctggtttcagagctatgctggaaacagc

SEQ ID NO: 65741 - DNA, 70 bp, Artificial Sequence
  Synthetic
gccaagcatttaggtgacactatagggttcaagatggagtcactcgtttcagagctatgctggaaacagc

SEQ ID NO: 65742 - DNA, 70 bp, Artificial Sequence
  Synthetic
gccaagcatttaggtgacactatagagaacggctttctgctgcaagtttcagagctatgctggaaacagc

SEQ ID NO: 65743 - DNA, 70 bp, Artificial Sequence
  Synthetic
gccaagcatttaggtgacactatagcaaagagttccgcagcaaacgtttcagagctatgctggaaacagc

SEQ ID NO: 65744 - DNA, 70 bp, Artificial Sequence
  Synthetic
gccaagcatttaggtgacactatagggtggagctacagaacacgagtttcagagctatgctggaaacagc

SEQ ID NO: 65745 - DNA, 70 bp, Artificial Sequence
  Synthetic
gccaagcatttaggtgacactatagtatcagggaaggacttcaaagtttcagagctatgctggaaacagc

SEQ ID NO: 65746 - DNA, 70 bp, Artificial Sequence
  Synthetic
gccaagcatttaggtgacactatagctgctgacccactggtcagggtttcagagctatgctggaaacagc

SEQ ID NO: 65747 - DNA, 70 bp, Artificial Sequence
  Synthetic
gccaagcatttaggtgacactatagccagggctacaccatgaggagtttcagagctatgctggaaacagc

SEQ ID NO: 65748 - DNA, 70 bp, Artificial Sequence
  Synthetic
gccaagcatttaggtgacactatagacgggaacacaggaaatcaggtttcagagctatgctggaaacagc

SEQ ID NO: 65749 - DNA, 70 bp, Artificial Sequence
  Synthetic
gccaagcatttaggtgacactatagctcactgacagcacttactggtttcagagctatgctggaaacagc

SEQ ID NO: 65750 - DNA, 70 bp, Artificial Sequence
  Synthetic
gccaagcatttaggtgacactatagaattgaagtgctgtgagaaagtttcagagctatgctggaaacagc

SEQ ID NO: 65751 - DNA, 70 bp, Artificial Sequence
  Synthetic
gccaagcatttaggtgacactatagtttggtggcagctaaggtatgtttcagagctatgctggaaacagc

SEQ ID NO: 65752 - DNA, 70 bp, Artificial Sequence
  Synthetic
gccaagcatttaggtgacactatagtctaaattctttgtgacctggtttcagagctatgctggaaacagc

SEQ ID NO: 65753 - DNA, 70 bp, Artificial Sequence
  Synthetic
gccaagcatttaggtgacactataggattctaaagggaaagtgctgtttcagagctatgctggaaacagc

SEQ ID NO: 65754 - DNA, 70 bp, Artificial Sequence
  Synthetic
gccaagcatttaggtgacactatagagacctttctttcagttttggtttcagagctatgctggaaacagc

SEQ ID NO: 65755 - DNA, 70 bp, Artificial Sequence
  Synthetic
gccaagcatttaggtgacactatagtgtgaatctatggagttgacgtttcagagctatgctggaaacagc

SEQ ID NO: 65756 - DNA, 70 bp, Artificial Sequence
  Synthetic
gccaagcatttaggtgacactatagctaagagaaaatgggtccctgtttcagagctatgctggaaacagc

SEQ ID NO: 65757 - DNA, 70 bp, Artificial Sequence
  Synthetic
gccaagcatttaggtgacactatagtctccatagattcacaagaggtttcagagctatgctggaaacagc

SEQ ID NO: 65758 - DNA, 70 bp, Artificial Sequence
  Synthetic
gccaagcatttaggtgacactatagtcatgaatctatggagatgagtttcagagctatgctggaaacagc

SEQ ID NO: 65759 - DNA, 70 bp, Artificial Sequence
  Synthetic
gccaagcatttaggtgacactatagtccattctcagcacagtgtcgtttcagagctatgctggaaacagc

SEQ ID NO: 65760 - DNA, 70 bp, Artificial Sequence
  Synthetic
gccaagcatttaggtgacactatagttcatctttacccaaaagaggtttcagagctatgctggaaacagc

SEQ ID NO: 65761 - DNA, 70 bp, Artificial Sequence
  Synthetic
gccaagcatttaggtgacactatagataatgagaacagaatgtccgtttcagagctatgctggaaacagc

SEQ ID NO: 65762 - DNA, 70 bp, Artificial Sequence
  Synthetic
gccaagcatttaggtgacactatagaaaagggcagactctgtgacgtttcagagctatgctggaaacagc

SEQ ID NO: 65763 - DNA, 70 bp, Artificial Sequence
  Synthetic
gccaagcatttaggtgacactataggttggcaaggggcttctggggtttcagagctatgctggaaacagc

SEQ ID NO: 65764 - DNA, 70 bp, Artificial Sequence
  Synthetic
gccaagcatttaggtgacactatagtgaggctactgtggcatcttgtttcagagctatgctggaaacagc

SEQ ID NO: 65765 - DNA, 70 bp, Artificial Sequence
  Synthetic
gccaagcatttaggtgacactatagcaaatgaggtactgggtgaagtttcagagctatgctggaaacagc

SEQ ID NO: 65766 - DNA, 70 bp, Artificial Sequence
  Synthetic
gccaagcatttaggtgacactataggcttcttgtttccccaaatcgtttcagagctatgctggaaacagc

SEQ ID NO: 65767 - DNA, 70 bp, Artificial Sequence
  Synthetic
gccaagcatttaggtgacactatagcatgtgaggtactgggtgaagtttcagagctatgctggaaacagc

SEQ ID NO: 65768 - DNA, 70 bp, Artificial Sequence
  Synthetic
gccaagcatttaggtgacactatagagatgctggggcccatgatcgtttcagagctatgctggaaacagc

SEQ ID NO: 65769 - DNA, 70 bp, Artificial Sequence
  Synthetic
gccaagcatttaggtgacactatagaaaggtgtgttttagcttctgtttcagagctatgctggaaacagc

SEQ ID NO: 65770 - DNA, 70 bp, Artificial Sequence
  Synthetic
gccaagcatttaggtgacactataggtcgtcgttcctcaaggtgtgtttcagagctatgctggaaacagc

SEQ ID NO: 65771 - DNA, 70 bp, Artificial Sequence
  Synthetic
gccaagcatttaggtgacactatagatgcatctctaaaggtgattgtttcagagctatgctggaaacagc

SEQ ID NO: 65772 - DNA, 70 bp, Artificial Sequence
  Synthetic
gccaagcatttaggtgacactatagtaaaataagtgagtgacccagtttcagagctatgctggaaacagc

SEQ ID NO: 65773 - DNA, 70 bp, Artificial Sequence
  Synthetic
gccaagcatttaggtgacactatagaggggtctctatggaacaaagtttcagagctatgctggaaacagc

SEQ ID NO: 65774 - DNA, 70 bp, Artificial Sequence
  Synthetic
gccaagcatttaggtgacactatagagcctgaagggtcagttcacgtttcagagctatgctggaaacagc

SEQ ID NO: 65775 - DNA, 70 bp, Artificial Sequence
  Synthetic
gccaagcatttaggtgacactatagccaggaggagtgtgataaatgtttcagagctatgctggaaacagc

SEQ ID NO: 65776 - DNA, 70 bp, Artificial Sequence
  Synthetic
gccaagcatttaggtgacactatagagtgtattggctaattccaggtttcagagctatgctggaaacagc

SEQ ID NO: 65777 - DNA, 70 bp, Artificial Sequence
  Synthetic
gccaagcatttaggtgacactatagtctctgcttaaagactgtaggtttcagagctatgctggaaacagc

SEQ ID NO: 65778 - DNA, 70 bp, Artificial Sequence
  Synthetic
gccaagcatttaggtgacactataggctatttctggagcaagtgtgtttcagagctatgctggaaacagc

SEQ ID NO: 65779 - DNA, 70 bp, Artificial Sequence
  Synthetic
gccaagcatttaggtgacactatagaatatattgcccaggtgaaagtttcagagctatgctggaaacagc

SEQ ID NO: 65780 - DNA, 70 bp, Artificial Sequence
  Synthetic
gccaagcatttaggtgacactatagatgaccagcaggtgtttgaagtttcagagctatgctggaaacagc

SEQ ID NO: 65781 - DNA, 70 bp, Artificial Sequence
  Synthetic
gccaagcatttaggtgacactatagtggtggctgctaggacagcagtttcagagctatgctggaaacagc

SEQ ID NO: 65782 - DNA, 70 bp, Artificial Sequence
  Synthetic
gccaagcatttaggtgacactataggcaagcaaggcctatctcccgtttcagagctatgctggaaacagc

SEQ ID NO: 65783 - DNA, 70 bp, Artificial Sequence
  Synthetic
gccaagcatttaggtgacactataggccgagggcagagagctgaggtttcagagctatgctggaaacagc

SEQ ID NO: 65784 - DNA, 70 bp, Artificial Sequence
  Synthetic
gccaagcatttaggtgacactataggcagagctgtcagtcgcccggtttcagagctatgctggaaacagc

SEQ ID NO: 65785 - DNA, 70 bp, Artificial Sequence
  Synthetic
gccaagcatttaggtgacactatagtagctgccagggttacaagtgtttcagagctatgctggaaacagc

SEQ ID NO: 65786 - DNA, 70 bp, Artificial Sequence
  Synthetic
gccaagcatttaggtgacactataggtcagaagtaagcgtcctgcgtttcagagctatgctggaaacagc

SEQ ID NO: 65787 - DNA, 70 bp, Artificial Sequence
  Synthetic
gccaagcatttaggtgacactatagcctggacacccgcttctgaggtttcagagctatgctggaaacagc

SEQ ID NO: 65788 - DNA, 70 bp, Artificial Sequence
  Synthetic
gccaagcatttaggtgacactatagcggggcccaagccatctttggtttcagagctatgctggaaacagc

SEQ ID NO: 65789 - DNA, 70 bp, Artificial Sequence
  Synthetic
gccaagcatttaggtgacactataggaagactagcttttcaaagcgtttcagagctatgctggaaacagc

SEQ ID NO: 65790 - DNA, 70 bp, Artificial Sequence
  Synthetic
gccaagcatttaggtgacactatagctccaagactcaaagtagccgtttcagagctatgctggaaacagc

SEQ ID NO: 65791 - DNA, 70 bp, Artificial Sequence
  Synthetic
gccaagcatttaggtgacactatagagtccgtccctccgacactggtttcagagctatgctggaaacagc

SEQ ID NO: 65792 - DNA, 70 bp, Artificial Sequence
  Synthetic
gccaagcatttaggtgacactatagagcaagaacagtgatcatgcgtttcagagctatgctggaaacagc

SEQ ID NO: 65793 - DNA, 70 bp, Artificial Sequence
  Synthetic
gccaagcatttaggtgacactatagggcctgctgggcccactaccgtttcagagctatgctggaaacagc

SEQ ID NO: 65794 - DNA, 70 bp, Artificial Sequence
  Synthetic
gccaagcatttaggtgacactatagttcggcttccgcagataggtgtttcagagctatgctggaaacagc

SEQ ID NO: 65795 - DNA, 70 bp, Artificial Sequence
  Synthetic
gccaagcatttaggtgacactatagtgcctggcggggttaggagtgtttcagagctatgctggaaacagc

SEQ ID NO: 65796 - DNA, 70 bp, Artificial Sequence
  Synthetic
gccaagcatttaggtgacactatagcctgatggaggtgacatcacgtttcagagctatgctggaaacagc

SEQ ID NO: 65797 - DNA, 70 bp, Artificial Sequence
  Synthetic
gccaagcatttaggtgacactataggtggagggggaagcctgactgtttcagagctatgctggaaacagc

SEQ ID NO: 65798 - DNA, 70 bp, Artificial Sequence
  Synthetic
gccaagcatttaggtgacactatagaacagctgcagctgaaacttgtttcagagctatgctggaaacagc

SEQ ID NO: 65799 - DNA, 70 bp, Artificial Sequence
  Synthetic
gccaagcatttaggtgacactataggcgggctttggtgtcctcaggtttcagagctatgctggaaacagc

SEQ ID NO: 65800 - DNA, 70 bp, Artificial Sequence
  Synthetic
gccaagcatttaggtgacactatagggctcatttcttgtagtgatgtttcagagctatgctggaaacagc

SEQ ID NO: 65801 - DNA, 70 bp, Artificial Sequence
  Synthetic
gccaagcatttaggtgacactatagccggaggagacagcacctatgtttcagagctatgctggaaacagc

SEQ ID NO: 65802 - DNA, 70 bp, Artificial Sequence
  Synthetic
gccaagcatttaggtgacactatagacagcagatcatgaaagtttgtttcagagctatgctggaaacagc

SEQ ID NO: 65803 - DNA, 70 bp, Artificial Sequence
  Synthetic
gccaagcatttaggtgacactatagaccgtggcacaggccgtcacgtttcagagctatgctggaaacagc

SEQ ID NO: 65804 - DNA, 70 bp, Artificial Sequence
  Synthetic
gccaagcatttaggtgacactataggccacagccgcatcttgatcgtttcagagctatgctggaaacagc

SEQ ID NO: 65805 - DNA, 70 bp, Artificial Sequence
  Synthetic
gccaagcatttaggtgacactatagccaggtgtctcatgatctttgtttcagagctatgctggaaacagc

SEQ ID NO: 65806 - DNA, 70 bp, Artificial Sequence
  Synthetic
gccaagcatttaggtgacactatagcaggcatgggtgtctctcgggtttcagagctatgctggaaacagc

SEQ ID NO: 65807 - DNA, 70 bp, Artificial Sequence
  Synthetic
gccaagcatttaggtgacactatagggagatgtggcaggataatagtttcagagctatgctggaaacagc

SEQ ID NO: 65808 - DNA, 70 bp, Artificial Sequence
  Synthetic
gccaagcatttaggtgacactataggaggaggaggatacctgagtgtttcagagctatgctggaaacagc

SEQ ID NO: 65809 - DNA, 70 bp, Artificial Sequence
  Synthetic
gccaagcatttaggtgacactatagccagctcggtcagctccagcgtttcagagctatgctggaaacagc

SEQ ID NO: 65810 - DNA, 70 bp, Artificial Sequence
  Synthetic
gccaagcatttaggtgacactatagtgatttcaggcagagctgctgtttcagagctatgctggaaacagc

SEQ ID NO: 65811 - DNA, 70 bp, Artificial Sequence
  Synthetic
gccaagcatttaggtgacactatagaaacccggcggtggaaacaggtttcagagctatgctggaaacagc

SEQ ID NO: 65812 - DNA, 70 bp, Artificial Sequence
  Synthetic
gccaagcatttaggtgacactatagatgtcaaacccctcatctttgtttcagagctatgctggaaacagc

SEQ ID NO: 65813 - DNA, 70 bp, Artificial Sequence
  Synthetic
gccaagcatttaggtgacactatagcagtgctgctgagagacatggtttcagagctatgctggaaacagc

SEQ ID NO: 65814 - DNA, 70 bp, Artificial Sequence
  Synthetic
gccaagcatttaggtgacactatagacctggacgtagaggggcctgtttcagagctatgctggaaacagc

SEQ ID NO: 65815 - DNA, 70 bp, Artificial Sequence
  Synthetic
gccaagcatttaggtgacactataggaaactaacaagaaagcagggtttcagagctatgctggaaacagc

SEQ ID NO: 65816 - DNA, 70 bp, Artificial Sequence
  Synthetic
gccaagcatttaggtgacactatagggcatatgaggagtacaaccgtttcagagctatgctggaaacagc

SEQ ID NO: 65817 - DNA, 70 bp, Artificial Sequence
  Synthetic
gccaagcatttaggtgacactatagccaaccgacctggacgtagagtttcagagctatgctggaaacagc

SEQ ID NO: 65818 - DNA, 70 bp, Artificial Sequence
  Synthetic
gccaagcatttaggtgacactatagagccgtgtgctcccacctcagtttcagagctatgctggaaacagc

SEQ ID NO: 65819 - DNA, 70 bp, Artificial Sequence
  Synthetic
gccaagcatttaggtgacactatagcctaacaacaaagccaagatgtttcagagctatgctggaaacagc

SEQ ID NO: 65820 - DNA, 70 bp, Artificial Sequence
  Synthetic
gccaagcatttaggtgacactatagggcactgtggtcagatgtccgtttcagagctatgctggaaacagc

SEQ ID NO: 65821 - DNA, 70 bp, Artificial Sequence
  Synthetic
gccaagcatttaggtgacactatagaggttgggtcagaatgtgcagtttcagagctatgctggaaacagc

SEQ ID NO: 65822 - DNA, 70 bp, Artificial Sequence
  Synthetic
gccaagcatttaggtgacactataggcgggtgcgttcagcttgaagtttcagagctatgctggaaacagc

SEQ ID NO: 65823 - DNA, 70 bp, Artificial Sequence
  Synthetic
gccaagcatttaggtgacactatagtaagttcagattgtgattgggtttcagagctatgctggaaacagc

SEQ ID NO: 65824 - DNA, 70 bp, Artificial Sequence
  Synthetic
gccaagcatttaggtgacactatagattcctagggatttacatctgtttcagagctatgctggaaacagc

SEQ ID NO: 65825 - DNA, 70 bp, Artificial Sequence
  Synthetic
gccaagcatttaggtgacactatagccaaggacaatgtgttattggtttcagagctatgctggaaacagc

SEQ ID NO: 65826 - DNA, 70 bp, Artificial Sequence
  Synthetic
gccaagcatttaggtgacactatagtcggccatgtccggctgacagtttcagagctatgctggaaacagc

SEQ ID NO: 65827 - DNA, 70 bp, Artificial Sequence
  Synthetic
gccaagcatttaggtgacactatagtcacagctgcaggcatcagcgtttcagagctatgctggaaacagc

SEQ ID NO: 65828 - DNA, 70 bp, Artificial Sequence
  Synthetic
gccaagcatttaggtgacactatagacttttggctttccatgtatgtttcagagctatgctggaaacagc

SEQ ID NO: 65829 - DNA, 70 bp, Artificial Sequence
  Synthetic
gccaagcatttaggtgacactatagtaaagaagcacgtttagtacgtttcagagctatgctggaaacagc

SEQ ID NO: 65830 - DNA, 70 bp, Artificial Sequence
  Synthetic
gccaagcatttaggtgacactatagcccggaggaggactacgggtgtttcagagctatgctggaaacagc

SEQ ID NO: 65831 - DNA, 70 bp, Artificial Sequence
  Synthetic
gccaagcatttaggtgacactatagtgacaactgcttagtcccacgtttcagagctatgctggaaacagc

SEQ ID NO: 65832 - DNA, 70 bp, Artificial Sequence
  Synthetic
gccaagcatttaggtgacactatagtccaaacaagcagctggatagtttcagagctatgctggaaacagc

SEQ ID NO: 65833 - DNA, 70 bp, Artificial Sequence
  Synthetic
gccaagcatttaggtgacactataggctccaggactggcttcagcgtttcagagctatgctggaaacagc

SEQ ID NO: 65834 - DNA, 70 bp, Artificial Sequence
  Synthetic
gccaagcatttaggtgacactataggagattgtctattagtgcgagtttcagagctatgctggaaacagc

SEQ ID NO: 65835 - DNA, 70 bp, Artificial Sequence
  Synthetic
gccaagcatttaggtgacactatagcattcctttggcattagggagtttcagagctatgctggaaacagc

SEQ ID NO: 65836 - DNA, 70 bp, Artificial Sequence
  Synthetic
gccaagcatttaggtgacactatagtcatatttgaggagatgggagtttcagagctatgctggaaacagc

SEQ ID NO: 65837 - DNA, 70 bp, Artificial Sequence
  Synthetic
gccaagcatttaggtgacactatagaaagacagtcaacgttgcgagtttcagagctatgctggaaacagc

SEQ ID NO: 65838 - DNA, 70 bp, Artificial Sequence
  Synthetic
gccaagcatttaggtgacactatagctggagaacagcaagatctagtttcagagctatgctggaaacagc

SEQ ID NO: 65839 - DNA, 70 bp, Artificial Sequence
  Synthetic
gccaagcatttaggtgacactataggtgggtgccagcgcgtccgagtttcagagctatgctggaaacagc

SEQ ID NO: 65840 - DNA, 70 bp, Artificial Sequence
  Synthetic
gccaagcatttaggtgacactatagactagtagcgctatttccgagtttcagagctatgctggaaacagc

SEQ ID NO: 65841 - DNA, 70 bp, Artificial Sequence
  Synthetic
gccaagcatttaggtgacactataggtgggcgccagcgcgtctgagtttcagagctatgctggaaacagc

SEQ ID NO: 65842 - DNA, 70 bp, Artificial Sequence
  Synthetic
gccaagcatttaggtgacactatagcctcccagagtcacttcttcgtttcagagctatgctggaaacagc

SEQ ID NO: 65843 - DNA, 70 bp, Artificial Sequence
  Synthetic
gccaagcatttaggtgacactatagtaaaggcgcactgccctagcgtttcagagctatgctggaaacagc

SEQ ID NO: 65844 - DNA, 70 bp, Artificial Sequence
  Synthetic
gccaagcatttaggtgacactataggattcaggaagacgacgtaagtttcagagctatgctggaaacagc

SEQ ID NO: 65845 - DNA, 70 bp, Artificial Sequence
  Synthetic
gccaagcatttaggtgacactatagacccatttgtgtttgaaagcgtttcagagctatgctggaaacagc

SEQ ID NO: 65846 - DNA, 70 bp, Artificial Sequence
  Synthetic
gccaagcatttaggtgacactatagatagatctcagaacgttcttgtttcagagctatgctggaaacagc

SEQ ID NO: 65847 - DNA, 70 bp, Artificial Sequence
  Synthetic
gccaagcatttaggtgacactatagtggcttctactcgcacagctgtttcagagctatgctggaaacagc

SEQ ID NO: 65848 - DNA, 70 bp, Artificial Sequence
  Synthetic
gccaagcatttaggtgacactatagtgaattgggctaccctgtgagtttcagagctatgctggaaacagc

SEQ ID NO: 65849 - DNA, 70 bp, Artificial Sequence
  Synthetic
gccaagcatttaggtgacactatagtgctgctggcacaagtcactgtttcagagctatgctggaaacagc

SEQ ID NO: 65850 - DNA, 70 bp, Artificial Sequence
  Synthetic
gccaagcatttaggtgacactatagcacactgcaaggacacttgagtttcagagctatgctggaaacagc

SEQ ID NO: 65851 - DNA, 70 bp, Artificial Sequence
  Synthetic
gccaagcatttaggtgacactataggactattgccccagataacagtttcagagctatgctggaaacagc

SEQ ID NO: 65852 - DNA, 70 bp, Artificial Sequence
  Synthetic
gccaagcatttaggtgacactataggcctcagcattcaacaaagagtttcagagctatgctggaaacagc

SEQ ID NO: 65853 - DNA, 70 bp, Artificial Sequence
  Synthetic
gccaagcatttaggtgacactatagcccagggcttctggcatcacgtttcagagctatgctggaaacagc

SEQ ID NO: 65854 - DNA, 70 bp, Artificial Sequence
  Synthetic
gccaagcatttaggtgacactatagtgtccgtgcacatggtttaagtttcagagctatgctggaaacagc

SEQ ID NO: 65855 - DNA, 70 bp, Artificial Sequence
  Synthetic
gccaagcatttaggtgacactatagatctcaagtatctgcacatagtttcagagctatgctggaaacagc

SEQ ID NO: 65856 - DNA, 70 bp, Artificial Sequence
  Synthetic
gccaagcatttaggtgacactatagtcctcactggatggttaagcgtttcagagctatgctggaaacagc

SEQ ID NO: 65857 - DNA, 70 bp, Artificial Sequence
  Synthetic
gccaagcatttaggtgacactatagccgggagtcgcccaagtgaggtttcagagctatgctggaaacagc

SEQ ID NO: 65858 - DNA, 70 bp, Artificial Sequence
  Synthetic
gccaagcatttaggtgacactatagccaggctcactgacattgaggtttcagagctatgctggaaacagc

SEQ ID NO: 65859 - DNA, 70 bp, Artificial Sequence
  Synthetic
gccaagcatttaggtgacactatagaaatggcgtcatcacagcaggtttcagagctatgctggaaacagc

SEQ ID NO: 65860 - DNA, 70 bp, Artificial Sequence
  Synthetic
gccaagcatttaggtgacactatagccttttgataaggaagctgagtttcagagctatgctggaaacagc

SEQ ID NO: 65861 - DNA, 70 bp, Artificial Sequence
  Synthetic
gccaagcatttaggtgacactatagagtcaagtttcttttggagagtttcagagctatgctggaaacagc

SEQ ID NO: 65862 - DNA, 70 bp, Artificial Sequence
  Synthetic
gccaagcatttaggtgacactatagcgtgtctgggacgggtctacgtttcagagctatgctggaaacagc

SEQ ID NO: 65863 - DNA, 70 bp, Artificial Sequence
  Synthetic
gccaagcatttaggtgacactatagactgtggagaactggactgagtttcagagctatgctggaaacagc

SEQ ID NO: 65864 - DNA, 70 bp, Artificial Sequence
  Synthetic
gccaagcatttaggtgacactatagtagctattgtcgctccactcgtttcagagctatgctggaaacagc

SEQ ID NO: 65865 - DNA, 70 bp, Artificial Sequence
  Synthetic
gccaagcatttaggtgacactatagcccagcagtggttcagtacagtttcagagctatgctggaaacagc

SEQ ID NO: 65866 - DNA, 70 bp, Artificial Sequence
  Synthetic
gccaagcatttaggtgacactatagcgttcacattcaatcctttcgtttcagagctatgctggaaacagc

SEQ ID NO: 65867 - DNA, 70 bp, Artificial Sequence
  Synthetic
gccaagcatttaggtgacactataggcagcgctccgggctgcagtgtttcagagctatgctggaaacagc

SEQ ID NO: 65868 - DNA, 70 bp, Artificial Sequence
  Synthetic
gccaagcatttaggtgacactatagccggcagccttctgtgtcaggtttcagagctatgctggaaacagc

SEQ ID NO: 65869 - DNA, 70 bp, Artificial Sequence
  Synthetic
gccaagcatttaggtgacactataggatttggattctagctgcaggtttcagagctatgctggaaacagc

SEQ ID NO: 65870 - DNA, 70 bp, Artificial Sequence
  Synthetic
gccaagcatttaggtgacactatagaatgtgtgaagtcttcaagagtttcagagctatgctggaaacagc

SEQ ID NO: 65871 - DNA, 70 bp, Artificial Sequence
  Synthetic
gccaagcatttaggtgacactatagtacctcctcacacagatgtagtttcagagctatgctggaaacagc

SEQ ID NO: 65872 - DNA, 70 bp, Artificial Sequence
  Synthetic
gccaagcatttaggtgacactatagtcttgacttcaatttcagtggtttcagagctatgctggaaacagc

SEQ ID NO: 65873 - DNA, 70 bp, Artificial Sequence
  Synthetic
gccaagcatttaggtgacactatagagcagaaattctgggagaaggtttcagagctatgctggaaacagc

SEQ ID NO: 65874 - DNA, 70 bp, Artificial Sequence
  Synthetic
gccaagcatttaggtgacactatagacctccgtgccaggaagtaagtttcagagctatgctggaaacagc

SEQ ID NO: 65875 - DNA, 70 bp, Artificial Sequence
  Synthetic
gccaagcatttaggtgacactatagattccttggaattggaagaagtttcagagctatgctggaaacagc

SEQ ID NO: 65876 - DNA, 70 bp, Artificial Sequence
  Synthetic
gccaagcatttaggtgacactataggtccagcagcatgcatcatagtttcagagctatgctggaaacagc

SEQ ID NO: 65877 - DNA, 70 bp, Artificial Sequence
  Synthetic
gccaagcatttaggtgacactataggaagcacagagaggctgagagtttcagagctatgctggaaacagc

SEQ ID NO: 65878 - DNA, 70 bp, Artificial Sequence
  Synthetic
gccaagcatttaggtgacactatagcgatggaagttctgttgagtgtttcagagctatgctggaaacagc

SEQ ID NO: 65879 - DNA, 70 bp, Artificial Sequence
  Synthetic
gccaagcatttaggtgacactataggcaacgagtgtggaaaccgcgtttcagagctatgctggaaacagc

SEQ ID NO: 65880 - DNA, 70 bp, Artificial Sequence
  Synthetic
gccaagcatttaggtgacactataggcaatgaatgtggcaatcgcgtttcagagctatgctggaaacagc

SEQ ID NO: 65881 - DNA, 70 bp, Artificial Sequence
  Synthetic
gccaagcatttaggtgacactatagaaaggccgaacacattaaatgtttcagagctatgctggaaacagc

SEQ ID NO: 65882 - DNA, 70 bp, Artificial Sequence
  Synthetic
gccaagcatttaggtgacactatagtggaaggccaaaggcattaagtttcagagctatgctggaaacagc

SEQ ID NO: 65883 - DNA, 70 bp, Artificial Sequence
  Synthetic
gccaagcatttaggtgacactatagtgccagggacactacacatagtttcagagctatgctggaaacagc

SEQ ID NO: 65884 - DNA, 70 bp, Artificial Sequence
  Synthetic
gccaagcatttaggtgacactatagggacatcttctaagtctttcgtttcagagctatgctggaaacagc

SEQ ID NO: 65885 - DNA, 70 bp, Artificial Sequence
  Synthetic
gccaagcatttaggtgacactatagcggggtgtcaggggagtgaggtttcagagctatgctggaaacagc

SEQ ID NO: 65886 - DNA, 70 bp, Artificial Sequence
  Synthetic
gccaagcatttaggtgacactatagttctaaccataggcattctcgtttcagagctatgctggaaacagc

SEQ ID NO: 65887 - DNA, 70 bp, Artificial Sequence
  Synthetic
gccaagcatttaggtgacactataggtccttatcctgtgtgctttgtttcagagctatgctggaaacagc

SEQ ID NO: 65888 - DNA, 70 bp, Artificial Sequence
  Synthetic
gccaagcatttaggtgacactatagacattaaataggggtaaggagtttcagagctatgctggaaacagc

SEQ ID NO: 65889 - DNA, 70 bp, Artificial Sequence
  Synthetic
gccaagcatttaggtgacactatagaccatagcaagtgggtgtgcgtttcagagctatgctggaaacagc

SEQ ID NO: 65890 - DNA, 70 bp, Artificial Sequence
  Synthetic
gccaagcatttaggtgacactatagcgtcctcaggtcactttttggtttcagagctatgctggaaacagc

SEQ ID NO: 65891 - DNA, 70 bp, Artificial Sequence
  Synthetic
gccaagcatttaggtgacactatagttattttgttgatcgtctcggtttcagagctatgctggaaacagc

SEQ ID NO: 65892 - DNA, 70 bp, Artificial Sequence
  Synthetic
gccaagcatttaggtgacactatagaggaaaacagactaaggctggtttcagagctatgctggaaacagc

SEQ ID NO: 65893 - DNA, 70 bp, Artificial Sequence
  Synthetic
gccaagcatttaggtgacactatagagtgaaactaccaaccctatgtttcagagctatgctggaaacagc

SEQ ID NO: 65894 - DNA, 70 bp, Artificial Sequence
  Synthetic
gccaagcatttaggtgacactatagagggtccaggctcatctccggtttcagagctatgctggaaacagc

SEQ ID NO: 65895 - DNA, 70 bp, Artificial Sequence
  Synthetic
gccaagcatttaggtgacactatagcgggctggcattcagacctagtttcagagctatgctggaaacagc

SEQ ID NO: 65896 - DNA, 70 bp, Artificial Sequence
  Synthetic
gccaagcatttaggtgacactatagcagtcggagcgggggtgagggtttcagagctatgctggaaacagc

SEQ ID NO: 65897 - DNA, 70 bp, Artificial Sequence
  Synthetic
gccaagcatttaggtgacactataggtgagactgtggagatgagagtttcagagctatgctggaaacagc

SEQ ID NO: 65898 - DNA, 70 bp, Artificial Sequence
  Synthetic
gccaagcatttaggtgacactataggcacctccaaggtcaggacggtttcagagctatgctggaaacagc

SEQ ID NO: 65899 - DNA, 70 bp, Artificial Sequence
  Synthetic
gccaagcatttaggtgacactatagttacaaccccaatctatacagtttcagagctatgctggaaacagc

SEQ ID NO: 65900 - DNA, 70 bp, Artificial Sequence
  Synthetic
gccaagcatttaggtgacactatagaattatttgtcaccaagagcgtttcagagctatgctggaaacagc

SEQ ID NO: 65901 - DNA, 70 bp, Artificial Sequence
  Synthetic
gccaagcatttaggtgacactatagtccaacagactcacagccttgtttcagagctatgctggaaacagc

SEQ ID NO: 65902 - DNA, 70 bp, Artificial Sequence
  Synthetic
gccaagcatttaggtgacactatagcgctgagggggagggggagtgtttcagagctatgctggaaacagc

SEQ ID NO: 65903 - DNA, 70 bp, Artificial Sequence
  Synthetic
gccaagcatttaggtgacactatagccccgccgggcacatgtgaagtttcagagctatgctggaaacagc

SEQ ID NO: 65904 - DNA, 70 bp, Artificial Sequence
  Synthetic
gccaagcatttaggtgacactataggcgaagcccacaaccccgccgtttcagagctatgctggaaacagc

SEQ ID NO: 65905 - DNA, 70 bp, Artificial Sequence
  Synthetic
gccaagcatttaggtgacactatagcacatgggacagatgtaaaagtttcagagctatgctggaaacagc

SEQ ID NO: 65906 - DNA, 70 bp, Artificial Sequence
  Synthetic
gccaagcatttaggtgacactatagccttccgatgacagtgctctgtttcagagctatgctggaaacagc

SEQ ID NO: 65907 - DNA, 70 bp, Artificial Sequence
  Synthetic
gccaagcatttaggtgacactatagaaccagcagacggattggtggtttcagagctatgctggaaacagc

SEQ ID NO: 65908 - DNA, 70 bp, Artificial Sequence
  Synthetic
gccaagcatttaggtgacactatagagccatcccagtcctcaagcgtttcagagctatgctggaaacagc

SEQ ID NO: 65909 - DNA, 70 bp, Artificial Sequence
  Synthetic
gccaagcatttaggtgacactatagctctcttcactattcctagggtttcagagctatgctggaaacagc

SEQ ID NO: 65910 - DNA, 70 bp, Artificial Sequence
  Synthetic
gccaagcatttaggtgacactatagaggggtcggggggagcttaggtttcagagctatgctggaaacagc

SEQ ID NO: 65911 - DNA, 70 bp, Artificial Sequence
  Synthetic
gccaagcatttaggtgacactatagctcagcccaccctcttcagagtttcagagctatgctggaaacagc

SEQ ID NO: 65912 - DNA, 70 bp, Artificial Sequence
  Synthetic
gccaagcatttaggtgacactatagagaagtgtcgggcactgttcgtttcagagctatgctggaaacagc

SEQ ID NO: 65913 - DNA, 70 bp, Artificial Sequence
  Synthetic
gccaagcatttaggtgacactataggacttggtgacgagcgacaggtttcagagctatgctggaaacagc

SEQ ID NO: 65914 - DNA, 70 bp, Artificial Sequence
  Synthetic
gccaagcatttaggtgacactataggatcaacagaataactggtggtttcagagctatgctggaaacagc

SEQ ID NO: 65915 - DNA, 70 bp, Artificial Sequence
  Synthetic
gccaagcatttaggtgacactatagaaatacatccaggaaagacagtttcagagctatgctggaaacagc

SEQ ID NO: 65916 - DNA, 70 bp, Artificial Sequence
  Synthetic
gccaagcatttaggtgacactatagctcgatggagatcaagtgatgtttcagagctatgctggaaacagc

SEQ ID NO: 65917 - DNA, 70 bp, Artificial Sequence
  Synthetic
gccaagcatttaggtgacactatagttggcaacatcacttaaggggtttcagagctatgctggaaacagc

SEQ ID NO: 65918 - DNA, 70 bp, Artificial Sequence
  Synthetic
gccaagcatttaggtgacactataggaggctggtactacaaaggggtttcagagctatgctggaaacagc

SEQ ID NO: 65919 - DNA, 70 bp, Artificial Sequence
  Synthetic
gccaagcatttaggtgacactatagacggacatccaaaaattgctgtttcagagctatgctggaaacagc

SEQ ID NO: 65920 - DNA, 70 bp, Artificial Sequence
  Synthetic
gccaagcatttaggtgacactatagttctcttcagtgaactttgagtttcagagctatgctggaaacagc

SEQ ID NO: 65921 - DNA, 70 bp, Artificial Sequence
  Synthetic
gccaagcatttaggtgacactatagttcgctgccacagatgactagtttcagagctatgctggaaacagc

SEQ ID NO: 65922 - DNA, 70 bp, Artificial Sequence
  Synthetic
gccaagcatttaggtgacactataggctgtgttctcacaagttcagtttcagagctatgctggaaacagc

SEQ ID NO: 65923 - DNA, 70 bp, Artificial Sequence
  Synthetic
gccaagcatttaggtgacactatagcagtgtcagtctttcctctcgtttcagagctatgctggaaacagc

SEQ ID NO: 65924 - DNA, 70 bp, Artificial Sequence
  Synthetic
gccaagcatttaggtgacactataggagaaaacttggaggttcgcgtttcagagctatgctggaaacagc

SEQ ID NO: 65925 - DNA, 70 bp, Artificial Sequence
  Synthetic
gccaagcatttaggtgacactatagttgagctgaggctggttagcgtttcagagctatgctggaaacagc

SEQ ID NO: 65926 - DNA, 70 bp, Artificial Sequence
  Synthetic
gccaagcatttaggtgacactatagatgggattcaagaagactccgtttcagagctatgctggaaacagc

SEQ ID NO: 65927 - DNA, 70 bp, Artificial Sequence
  Synthetic
gccaagcatttaggtgacactatagttcttctttttcttctgggagtttcagagctatgctggaaacagc

SEQ ID NO: 65928 - DNA, 70 bp, Artificial Sequence
  Synthetic
gccaagcatttaggtgacactatagtatgaagatgctgttcactcgtttcagagctatgctggaaacagc

SEQ ID NO: 65929 - DNA, 70 bp, Artificial Sequence
  Synthetic
gccaagcatttaggtgacactatagccctgtgcagagagacgggggtttcagagctatgctggaaacagc

SEQ ID NO: 65930 - DNA, 70 bp, Artificial Sequence
  Synthetic
gccaagcatttaggtgacactatagcaggacatggggccctgaccgtttcagagctatgctggaaacagc

SEQ ID NO: 65931 - DNA, 70 bp, Artificial Sequence
  Synthetic
gccaagcatttaggtgacactatagccaggcactggaaacaaaaggtttcagagctatgctggaaacagc

SEQ ID NO: 65932 - DNA, 70 bp, Artificial Sequence
  Synthetic
gccaagcatttaggtgacactataggggtgcatacacgttaggatgtttcagagctatgctggaaacagc

SEQ ID NO: 65933 - DNA, 70 bp, Artificial Sequence
  Synthetic
gccaagcatttaggtgacactatagaaagcaaggtcagcctcatggtttcagagctatgctggaaacagc

SEQ ID NO: 65934 - DNA, 70 bp, Artificial Sequence
  Synthetic
gccaagcatttaggtgacactatagcaatgaggaagccatggggagtttcagagctatgctggaaacagc

SEQ ID NO: 65935 - DNA, 70 bp, Artificial Sequence
  Synthetic
gccaagcatttaggtgacactatagggggtccagcactatcagttgtttcagagctatgctggaaacagc

SEQ ID NO: 65936 - DNA, 70 bp, Artificial Sequence
  Synthetic
gccaagcatttaggtgacactatagaccatcagttcttttgtcttgtttcagagctatgctggaaacagc

SEQ ID NO: 65937 - DNA, 70 bp, Artificial Sequence
  Synthetic
gccaagcatttaggtgacactatagaatggccctgagaactctgtgtttcagagctatgctggaaacagc

SEQ ID NO: 65938 - DNA, 70 bp, Artificial Sequence
  Synthetic
gccaagcatttaggtgacactatagatcctacgtggcactggtctgtttcagagctatgctggaaacagc

SEQ ID NO: 65939 - DNA, 70 bp, Artificial Sequence
  Synthetic
gccaagcatttaggtgacactatagtatcacttttaggatcccaggtttcagagctatgctggaaacagc

SEQ ID NO: 65940 - DNA, 70 bp, Artificial Sequence
  Synthetic
gccaagcatttaggtgacactatagttctgcgttgtagcagcattgtttcagagctatgctggaaacagc

SEQ ID NO: 65941 - DNA, 70 bp, Artificial Sequence
  Synthetic
gccaagcatttaggtgacactataggggctctactgcgagtgagggtttcagagctatgctggaaacagc

SEQ ID NO: 65942 - DNA, 70 bp, Artificial Sequence
  Synthetic
gccaagcatttaggtgacactatagaaacgggaagaagaagttaagtttcagagctatgctggaaacagc

SEQ ID NO: 65943 - DNA, 70 bp, Artificial Sequence
  Synthetic
gccaagcatttaggtgacactatagtcaaggttaccaggaaaactgtttcagagctatgctggaaacagc

SEQ ID NO: 65944 - DNA, 70 bp, Artificial Sequence
  Synthetic
gccaagcatttaggtgacactatagccaggtggttgtctaactatgtttcagagctatgctggaaacagc

SEQ ID NO: 65945 - DNA, 70 bp, Artificial Sequence
  Synthetic
gccaagcatttaggtgacactatagatcctgtgcctcttactactgtttcagagctatgctggaaacagc

SEQ ID NO: 65946 - DNA, 70 bp, Artificial Sequence
  Synthetic
gccaagcatttaggtgacactatagagaagcaccattcttaagcagtttcagagctatgctggaaacagc

SEQ ID NO: 65947 - DNA, 70 bp, Artificial Sequence
  Synthetic
gccaagcatttaggtgacactatagactaccacttttatgctagtgtttcagagctatgctggaaacagc

SEQ ID NO: 65948 - DNA, 70 bp, Artificial Sequence
  Synthetic
gccaagcatttaggtgacactatagtgattcatcactgctgaagtgtttcagagctatgctggaaacagc

SEQ ID NO: 65949 - DNA, 70 bp, Artificial Sequence
  Synthetic
gccaagcatttaggtgacactatagagtgcctcaagattctcagggtttcagagctatgctggaaacagc

SEQ ID NO: 65950 - DNA, 70 bp, Artificial Sequence
  Synthetic
gccaagcatttaggtgacactataggtgccctcctgagaatcttggtttcagagctatgctggaaacagc

SEQ ID NO: 65951 - DNA, 70 bp, Artificial Sequence
  Synthetic
gccaagcatttaggtgacactatagagatttcctagtgatcactggtttcagagctatgctggaaacagc

SEQ ID NO: 65952 - DNA, 70 bp, Artificial Sequence
  Synthetic
gccaagcatttaggtgacactatagttgctgtttcctgtctcatagtttcagagctatgctggaaacagc

SEQ ID NO: 65953 - DNA, 70 bp, Artificial Sequence
  Synthetic
gccaagcatttaggtgacactatagaatcactggtgctttgaactgtttcagagctatgctggaaacagc

SEQ ID NO: 65954 - DNA, 70 bp, Artificial Sequence
  Synthetic
gccaagcatttaggtgacactatagtctgcagcaggctgctgcctgtttcagagctatgctggaaacagc

SEQ ID NO: 65955 - DNA, 70 bp, Artificial Sequence
  Synthetic
gccaagcatttaggtgacactatagcctgatcctttgagagctgagtttcagagctatgctggaaacagc

SEQ ID NO: 65956 - DNA, 70 bp, Artificial Sequence
  Synthetic
gccaagcatttaggtgacactataggcagtaattgcatcaagatggtttcagagctatgctggaaacagc

SEQ ID NO: 65957 - DNA, 70 bp, Artificial Sequence
  Synthetic
gccaagcatttaggtgacactatagaccccgggctcggaactaatgtttcagagctatgctggaaacagc

SEQ ID NO: 65958 - DNA, 70 bp, Artificial Sequence
  Synthetic
gccaagcatttaggtgacactatagtgaaaaggatggaagcatgagtttcagagctatgctggaaacagc

SEQ ID NO: 65959 - DNA, 70 bp, Artificial Sequence
  Synthetic
gccaagcatttaggtgacactataggaaaaggggtttggaggtgagtttcagagctatgctggaaacagc

SEQ ID NO: 65960 - DNA, 70 bp, Artificial Sequence
  Synthetic
gccaagcatttaggtgacactatagcgttgccagacaccgataccgtttcagagctatgctggaaacagc

SEQ ID NO: 65961 - DNA, 70 bp, Artificial Sequence
  Synthetic
gccaagcatttaggtgacactatagctccacaaactggttgtgctgtttcagagctatgctggaaacagc

SEQ ID NO: 65962 - DNA, 70 bp, Artificial Sequence
  Synthetic
gccaagcatttaggtgacactatagagagtaagtagtcatcttcagtttcagagctatgctggaaacagc

SEQ ID NO: 65963 - DNA, 70 bp, Artificial Sequence
  Synthetic
gccaagcatttaggtgacactatagccggaggaggcggagtgagggtttcagagctatgctggaaacagc

SEQ ID NO: 65964 - DNA, 70 bp, Artificial Sequence
  Synthetic
gccaagcatttaggtgacactatagggagcctgcgcgcggcaggggtttcagagctatgctggaaacagc

SEQ ID NO: 65965 - DNA, 70 bp, Artificial Sequence
  Synthetic
gccaagcatttaggtgacactatagacaagaaactctactctgcagtttcagagctatgctggaaacagc

SEQ ID NO: 65966 - DNA, 70 bp, Artificial Sequence
  Synthetic
gccaagcatttaggtgacactatagcgcctggtcagggactgaaggtttcagagctatgctggaaacagc

SEQ ID NO: 65967 - DNA, 70 bp, Artificial Sequence
  Synthetic
gccaagcatttaggtgacactatagtacaagctcgtcaaagactagtttcagagctatgctggaaacagc

SEQ ID NO: 65968 - DNA, 70 bp, Artificial Sequence
  Synthetic
gccaagcatttaggtgacactatagtcagcaccacatctacaggcgtttcagagctatgctggaaacagc

SEQ ID NO: 65969 - DNA, 70 bp, Artificial Sequence
  Synthetic
gccaagcatttaggtgacactatagcgcagcagatcttcgaaagagtttcagagctatgctggaaacagc

SEQ ID NO: 65970 - DNA, 70 bp, Artificial Sequence
  Synthetic
gccaagcatttaggtgacactatagcatggccccgtctgctgctggtttcagagctatgctggaaacagc

SEQ ID NO: 65971 - DNA, 70 bp, Artificial Sequence
  Synthetic
gccaagcatttaggtgacactatagacgagtgggaggtcatctgagtttcagagctatgctggaaacagc

SEQ ID NO: 65972 - DNA, 70 bp, Artificial Sequence
  Synthetic
gccaagcatttaggtgacactatagccaggtaagcagaagttagcgtttcagagctatgctggaaacagc

SEQ ID NO: 65973 - DNA, 70 bp, Artificial Sequence
  Synthetic
gccaagcatttaggtgacactatagcaggggtgagcgctcagagcgtttcagagctatgctggaaacagc

SEQ ID NO: 65974 - DNA, 70 bp, Artificial Sequence
  Synthetic
gccaagcatttaggtgacactataggagtatccagatgtctttgtgtttcagagctatgctggaaacagc

SEQ ID NO: 65975 - DNA, 70 bp, Artificial Sequence
  Synthetic
gccaagcatttaggtgacactatagcttcaatggaacttcaagtcgtttcagagctatgctggaaacagc

SEQ ID NO: 65976 - DNA, 70 bp, Artificial Sequence
  Synthetic
gccaagcatttaggtgacactatagggggatttgtgccgtgttatgtttcagagctatgctggaaacagc

SEQ ID NO: 65977 - DNA, 70 bp, Artificial Sequence
  Synthetic
gccaagcatttaggtgacactatagtcccgccacctggacgctgagtttcagagctatgctggaaacagc

SEQ ID NO: 65978 - DNA, 70 bp, Artificial Sequence
  Synthetic
gccaagcatttaggtgacactatagatgggaaaggctcagactgcgtttcagagctatgctggaaacagc

SEQ ID NO: 65979 - DNA, 70 bp, Artificial Sequence
  Synthetic
gccaagcatttaggtgacactatagcactgtaggccctgtctcaggtttcagagctatgctggaaacagc

SEQ ID NO: 65980 - DNA, 70 bp, Artificial Sequence
  Synthetic
gccaagcatttaggtgacactatagggcggggggcacgggttacagtttcagagctatgctggaaacagc

SEQ ID NO: 65981 - DNA, 70 bp, Artificial Sequence
  Synthetic
gccaagcatttaggtgacactatagtctgatgggaagaacacccggtttcagagctatgctggaaacagc

SEQ ID NO: 65982 - DNA, 70 bp, Artificial Sequence
  Synthetic
gccaagcatttaggtgacactatagttctgctgaagaagcggcctgtttcagagctatgctggaaacagc

SEQ ID NO: 65983 - DNA, 70 bp, Artificial Sequence
  Synthetic
gccaagcatttaggtgacactatagtactattagcagacagcatcgtttcagagctatgctggaaacagc

SEQ ID NO: 65984 - DNA, 70 bp, Artificial Sequence
  Synthetic
gccaagcatttaggtgacactatagcaaaagctgccagctggagcgtttcagagctatgctggaaacagc

SEQ ID NO: 65985 - DNA, 70 bp, Artificial Sequence
  Synthetic
gccaagcatttaggtgacactatagcggctggtcggcttctgctagtttcagagctatgctggaaacagc

SEQ ID NO: 65986 - DNA, 70 bp, Artificial Sequence
  Synthetic
gccaagcatttaggtgacactatagagcaccgtgccgctgctcacgtttcagagctatgctggaaacagc

SEQ ID NO: 65987 - DNA, 70 bp, Artificial Sequence
  Synthetic
gccaagcatttaggtgacactataggccagggcggtgctcaggtggtttcagagctatgctggaaacagc

SEQ ID NO: 65988 - DNA, 70 bp, Artificial Sequence
  Synthetic
gccaagcatttaggtgacactatagctccagggactagggagacggtttcagagctatgctggaaacagc

SEQ ID NO: 65989 - DNA, 70 bp, Artificial Sequence
  Synthetic
gccaagcatttaggtgacactataggctaggctgctgtttcctacgtttcagagctatgctggaaacagc

SEQ ID NO: 65990 - DNA, 70 bp, Artificial Sequence
  Synthetic
gccaagcatttaggtgacactataggacagagcgaaataggcagggtttcagagctatgctggaaacagc

SEQ ID NO: 65991 - DNA, 70 bp, Artificial Sequence
  Synthetic
gccaagcatttaggtgacactataggacagaatgagatgggaaaggtttcagagctatgctggaaacagc

SEQ ID NO: 65992 - DNA, 70 bp, Artificial Sequence
  Synthetic
gccaagcatttaggtgacactatagggcagagcgagatcggcagggtttcagagctatgctggaaacagc

SEQ ID NO: 65993 - DNA, 70 bp, Artificial Sequence
  Synthetic
gccaagcatttaggtgacactatagttggtcctctctgtcacctcgtttcagagctatgctggaaacagc

SEQ ID NO: 65994 - DNA, 70 bp, Artificial Sequence
  Synthetic
gccaagcatttaggtgacactatagcttgccgtgggagacgtgcagtttcagagctatgctggaaacagc

SEQ ID NO: 65995 - DNA, 70 bp, Artificial Sequence
  Synthetic
gccaagcatttaggtgacactatagcctttccagagattaatgccgtttcagagctatgctggaaacagc

SEQ ID NO: 65996 - DNA, 70 bp, Artificial Sequence
  Synthetic
gccaagcatttaggtgacactatagggccatcgggtcaggcgttcgtttcagagctatgctggaaacagc

SEQ ID NO: 65997 - DNA, 70 bp, Artificial Sequence
  Synthetic
gccaagcatttaggtgacactatagagctgcacacgtggggtgttgtttcagagctatgctggaaacagc

SEQ ID NO: 65998 - DNA, 70 bp, Artificial Sequence
  Synthetic
gccaagcatttaggtgacactatagtcctggaacctcaggatattgtttcagagctatgctggaaacagc

SEQ ID NO: 65999 - DNA, 70 bp, Artificial Sequence
  Synthetic
gccaagcatttaggtgacactatagcaatcagtcttcgctgtctggtttcagagctatgctggaaacagc

SEQ ID NO: 66000 - DNA, 70 bp, Artificial Sequence
  Synthetic
gccaagcatttaggtgacactatagtggcggaccatgaaaagactgtttcagagctatgctggaaacagc

SEQ ID NO: 66001 - DNA, 70 bp, Artificial Sequence
  Synthetic
gccaagcatttaggtgacactataggtgctcagaatgtagctcgggtttcagagctatgctggaaacagc

SEQ ID NO: 66002 - DNA, 70 bp, Artificial Sequence
  Synthetic
gccaagcatttaggtgacactatagtcaagaccatcctggactgagtttcagagctatgctggaaacagc

SEQ ID NO: 66003 - DNA, 70 bp, Artificial Sequence
  Synthetic
gccaagcatttaggtgacactatagtaagaagaggatgtcttagggtttcagagctatgctggaaacagc

SEQ ID NO: 66004 - DNA, 70 bp, Artificial Sequence
  Synthetic
gccaagcatttaggtgacactatagcggaggtggcggtgggtcaggtttcagagctatgctggaaacagc

SEQ ID NO: 66005 - DNA, 70 bp, Artificial Sequence
  Synthetic
gccaagcatttaggtgacactatagcactgctaagagcgtgccccgtttcagagctatgctggaaacagc

SEQ ID NO: 66006 - DNA, 70 bp, Artificial Sequence
  Synthetic
gccaagcatttaggtgacactatagggaaagcaggatgggtgagggtttcagagctatgctggaaacagc

SEQ ID NO: 66007 - DNA, 70 bp, Artificial Sequence
  Synthetic
gccaagcatttaggtgacactatagaaaataactttggctgggtagtttcagagctatgctggaaacagc

SEQ ID NO: 66008 - DNA, 70 bp, Artificial Sequence
  Synthetic
gccaagcatttaggtgacactatagtgatcctggaggaatttggagtttcagagctatgctggaaacagc

SEQ ID NO: 66009 - DNA, 70 bp, Artificial Sequence
  Synthetic
gccaagcatttaggtgacactatagcaccaccaccagacttttgcgtttcagagctatgctggaaacagc

SEQ ID NO: 66010 - DNA, 70 bp, Artificial Sequence
  Synthetic
gccaagcatttaggtgacactatagcctataaccattgggtctgagtttcagagctatgctggaaacagc

SEQ ID NO: 66011 - DNA, 70 bp, Artificial Sequence
  Synthetic
gccaagcatttaggtgacactatagatgccttcactcgggtcacagtttcagagctatgctggaaacagc

SEQ ID NO: 66012 - DNA, 70 bp, Artificial Sequence
  Synthetic
gccaagcatttaggtgacactatagcagaaatgtactgagacacagtttcagagctatgctggaaacagc

SEQ ID NO: 66013 - DNA, 70 bp, Artificial Sequence
  Synthetic
gccaagcatttaggtgacactatagcccctacagccgctggatctgtttcagagctatgctggaaacagc

SEQ ID NO: 66014 - DNA, 70 bp, Artificial Sequence
  Synthetic
gccaagcatttaggtgacactatagctggctacagtgtattgaaggtttcagagctatgctggaaacagc

SEQ ID NO: 66015 - DNA, 70 bp, Artificial Sequence
  Synthetic
gccaagcatttaggtgacactatagataaatgatggcagcagcaagtttcagagctatgctggaaacagc

SEQ ID NO: 66016 - DNA, 70 bp, Artificial Sequence
  Synthetic
gccaagcatttaggtgacactatagctactggagcaagtcagattgtttcagagctatgctggaaacagc

SEQ ID NO: 66017 - DNA, 70 bp, Artificial Sequence
  Synthetic
gccaagcatttaggtgacactatagaaagagagttcctgcgacaggtttcagagctatgctggaaacagc

SEQ ID NO: 66018 - DNA, 70 bp, Artificial Sequence
  Synthetic
gccaagcatttaggtgacactatagttgcatttctgcactcaatggtttcagagctatgctggaaacagc

SEQ ID NO: 66019 - DNA, 70 bp, Artificial Sequence
  Synthetic
gccaagcatttaggtgacactatagtgaccacaggctagcatcaggtttcagagctatgctggaaacagc

SEQ ID NO: 66020 - DNA, 70 bp, Artificial Sequence
  Synthetic
gccaagcatttaggtgacactatagtgaaatcaatgagtttacgcgtttcagagctatgctggaaacagc

SEQ ID NO: 66021 - DNA, 70 bp, Artificial Sequence
  Synthetic
gccaagcatttaggtgacactataggagtgacttgtcagactgatgtttcagagctatgctggaaacagc

SEQ ID NO: 66022 - DNA, 70 bp, Artificial Sequence
  Synthetic
gccaagcatttaggtgacactataggaagactattttcagtgtccgtttcagagctatgctggaaacagc

SEQ ID NO: 66023 - DNA, 70 bp, Artificial Sequence
  Synthetic
gccaagcatttaggtgacactatagagcttctttccttcatagcagtttcagagctatgctggaaacagc

SEQ ID NO: 66024 - DNA, 70 bp, Artificial Sequence
  Synthetic
gccaagcatttaggtgacactatagggctgctgatcagccatgatgtttcagagctatgctggaaacagc

SEQ ID NO: 66025 - DNA, 70 bp, Artificial Sequence
  Synthetic
gccaagcatttaggtgacactataggctgaatggggctcttaggagtttcagagctatgctggaaacagc

SEQ ID NO: 66026 - DNA, 70 bp, Artificial Sequence
  Synthetic
gccaagcatttaggtgacactatagctttgtaggaaagactctgagtttcagagctatgctggaaacagc

SEQ ID NO: 66027 - DNA, 70 bp, Artificial Sequence
  Synthetic
gccaagcatttaggtgacactatagtcagtatatcttctgacgacgtttcagagctatgctggaaacagc

SEQ ID NO: 66028 - DNA, 70 bp, Artificial Sequence
  Synthetic
gccaagcatttaggtgacactatagcactgcccctgagaagggcagtttcagagctatgctggaaacagc

SEQ ID NO: 66029 - DNA, 70 bp, Artificial Sequence
  Synthetic
gccaagcatttaggtgacactatagtccagcagatggaccttaaggtttcagagctatgctggaaacagc

SEQ ID NO: 66030 - DNA, 70 bp, Artificial Sequence
  Synthetic
gccaagcatttaggtgacactatagaacagaagccgaagaaactggtttcagagctatgctggaaacagc

SEQ ID NO: 66031 - DNA, 70 bp, Artificial Sequence
  Synthetic
gccaagcatttaggtgacactatagattccatggcagtgaaaggagtttcagagctatgctggaaacagc

SEQ ID NO: 66032 - DNA, 70 bp, Artificial Sequence
  Synthetic
gccaagcatttaggtgacactatagtcaatccagtggattttatggtttcagagctatgctggaaacagc

SEQ ID NO: 66033 - DNA, 70 bp, Artificial Sequence
  Synthetic
gccaagcatttaggtgacactatagactgtgtcaaaactagtactgtttcagagctatgctggaaacagc

SEQ ID NO: 66034 - DNA, 70 bp, Artificial Sequence
  Synthetic
gccaagcatttaggtgacactatagactgtgcatcttaaggagctgtttcagagctatgctggaaacagc

SEQ ID NO: 66035 - DNA, 70 bp, Artificial Sequence
  Synthetic
gccaagcatttaggtgacactatagcaaagtcccagactgagggagtttcagagctatgctggaaacagc

SEQ ID NO: 66036 - DNA, 70 bp, Artificial Sequence
  Synthetic
gccaagcatttaggtgacactatagcagtgggactgctggatctagtttcagagctatgctggaaacagc

SEQ ID NO: 66037 - DNA, 70 bp, Artificial Sequence
  Synthetic
gccaagcatttaggtgacactatagaaggttcactgttgacaaaagtttcagagctatgctggaaacagc

SEQ ID NO: 66038 - DNA, 70 bp, Artificial Sequence
  Synthetic
gccaagcatttaggtgacactatagcccaaagagctcacactgcagtttcagagctatgctggaaacagc

SEQ ID NO: 66039 - DNA, 70 bp, Artificial Sequence
  Synthetic
gccaagcatttaggtgacactatagatgccattttaccagtaggagtttcagagctatgctggaaacagc

SEQ ID NO: 66040 - DNA, 70 bp, Artificial Sequence
  Synthetic
gccaagcatttaggtgacactatagagaggaggctacagttctgagtttcagagctatgctggaaacagc

SEQ ID NO: 66041 - DNA, 70 bp, Artificial Sequence
  Synthetic
gccaagcatttaggtgacactatagtgatttcccatggcttcagggtttcagagctatgctggaaacagc

SEQ ID NO: 66042 - DNA, 70 bp, Artificial Sequence
  Synthetic
gccaagcatttaggtgacactatagtgcagggctctaatcatagtgtttcagagctatgctggaaacagc

SEQ ID NO: 66043 - DNA, 70 bp, Artificial Sequence
  Synthetic
gccaagcatttaggtgacactataggccaagatggcatttattgcgtttcagagctatgctggaaacagc

SEQ ID NO: 66044 - DNA, 70 bp, Artificial Sequence
  Synthetic
gccaagcatttaggtgacactatagtcgagttcccccagctaatggtttcagagctatgctggaaacagc

SEQ ID NO: 66045 - DNA, 70 bp, Artificial Sequence
  Synthetic
gccaagcatttaggtgacactataggcctgctccttcacgtttctgtttcagagctatgctggaaacagc

SEQ ID NO: 66046 - DNA, 70 bp, Artificial Sequence
  Synthetic
gccaagcatttaggtgacactatagtccagccatgcctcactggggtttcagagctatgctggaaacagc

SEQ ID NO: 66047 - DNA, 70 bp, Artificial Sequence
  Synthetic
gccaagcatttaggtgacactatagatcactctattctcaatgacgtttcagagctatgctggaaacagc

SEQ ID NO: 66048 - DNA, 70 bp, Artificial Sequence
  Synthetic
gccaagcatttaggtgacactatagtatacaagatctgggagcacgtttcagagctatgctggaaacagc

SEQ ID NO: 66049 - DNA, 70 bp, Artificial Sequence
  Synthetic
gccaagcatttaggtgacactatagaaggaagaaggaggcagtaagtttcagagctatgctggaaacagc

SEQ ID NO: 66050 - DNA, 70 bp, Artificial Sequence
  Synthetic
gccaagcatttaggtgacactataggatgctatctttcactgagggtttcagagctatgctggaaacagc

SEQ ID NO: 66051 - DNA, 70 bp, Artificial Sequence
  Synthetic
gccaagcatttaggtgacactatagttaaggtctacggaaagtgcgtttcagagctatgctggaaacagc

SEQ ID NO: 66052 - DNA, 70 bp, Artificial Sequence
  Synthetic
gccaagcatttaggtgacactatagacaacgaaaatatggtgctggtttcagagctatgctggaaacagc

SEQ ID NO: 66053 - DNA, 70 bp, Artificial Sequence
  Synthetic
gccaagcatttaggtgacactataggaggagaagcacagaaagtggtttcagagctatgctggaaacagc

SEQ ID NO: 66054 - DNA, 70 bp, Artificial Sequence
  Synthetic
gccaagcatttaggtgacactataggcgacaaggaggagaaacacgtttcagagctatgctggaaacagc

SEQ ID NO: 66055 - DNA, 70 bp, Artificial Sequence
  Synthetic
gccaagcatttaggtgacactatagtggagaaaatggagaaacacgtttcagagctatgctggaaacagc

SEQ ID NO: 66056 - DNA, 70 bp, Artificial Sequence
  Synthetic
gccaagcatttaggtgacactatagtcagaggctgccgtgaaagagtttcagagctatgctggaaacagc

SEQ ID NO: 66057 - DNA, 70 bp, Artificial Sequence
  Synthetic
gccaagcatttaggtgacactatagaagcagttatttccgatgctgtttcagagctatgctggaaacagc

SEQ ID NO: 66058 - DNA, 70 bp, Artificial Sequence
  Synthetic
gccaagcatttaggtgacactatagggaggagccgtcgggggacggtttcagagctatgctggaaacagc

SEQ ID NO: 66059 - DNA, 70 bp, Artificial Sequence
  Synthetic
gccaagcatttaggtgacactataggaaggaaatactgccatcgagtttcagagctatgctggaaacagc

SEQ ID NO: 66060 - DNA, 70 bp, Artificial Sequence
  Synthetic
gccaagcatttaggtgacactataggaggctcttaaagtgtgagagtttcagagctatgctggaaacagc

SEQ ID NO: 66061 - DNA, 70 bp, Artificial Sequence
  Synthetic
gccaagcatttaggtgacactatagctagttgctacctatcttccgtttcagagctatgctggaaacagc

SEQ ID NO: 66062 - DNA, 70 bp, Artificial Sequence
  Synthetic
gccaagcatttaggtgacactatagatgagcacatgaattcctgtgtttcagagctatgctggaaacagc

SEQ ID NO: 66063 - DNA, 70 bp, Artificial Sequence
  Synthetic
gccaagcatttaggtgacactatagtaccacatcatcctgaaatggtttcagagctatgctggaaacagc

SEQ ID NO: 66064 - DNA, 70 bp, Artificial Sequence
  Synthetic
gccaagcatttaggtgacactatagtgacttcaacgagaatgacggtttcagagctatgctggaaacagc

SEQ ID NO: 66065 - DNA, 70 bp, Artificial Sequence
  Synthetic
gccaagcatttaggtgacactatagctcttgtctttattctgggggtttcagagctatgctggaaacagc

SEQ ID NO: 66066 - DNA, 70 bp, Artificial Sequence
  Synthetic
gccaagcatttaggtgacactatagcgacctcagtgagaatgacggtttcagagctatgctggaaacagc

SEQ ID NO: 66067 - DNA, 70 bp, Artificial Sequence
  Synthetic
gccaagcatttaggtgacactatagatggaagaggagtcctgatcgtttcagagctatgctggaaacagc

SEQ ID NO: 66068 - DNA, 70 bp, Artificial Sequence
  Synthetic
gccaagcatttaggtgacactatagagcagcttcagcatggaggagtttcagagctatgctggaaacagc

SEQ ID NO: 66069 - DNA, 70 bp, Artificial Sequence
  Synthetic
gccaagcatttaggtgacactatagagtagctttagctcagatgagtttcagagctatgctggaaacagc

SEQ ID NO: 66070 - DNA, 70 bp, Artificial Sequence
  Synthetic
gccaagcatttaggtgacactatagggagggacgtcgatggtattgtttcagagctatgctggaaacagc

SEQ ID NO: 66071 - DNA, 70 bp, Artificial Sequence
  Synthetic
gccaagcatttaggtgacactataggaaccagcctctcttagtaagtttcagagctatgctggaaacagc

SEQ ID NO: 66072 - DNA, 70 bp, Artificial Sequence
  Synthetic
gccaagcatttaggtgacactataggcagctggaggtgcctcagagtttcagagctatgctggaaacagc

SEQ ID NO: 66073 - DNA, 70 bp, Artificial Sequence
  Synthetic
gccaagcatttaggtgacactatagggacctggttatcgataagggtttcagagctatgctggaaacagc

SEQ ID NO: 66074 - DNA, 70 bp, Artificial Sequence
  Synthetic
gccaagcatttaggtgacactatagtggacctgccacagttcactgtttcagagctatgctggaaacagc

SEQ ID NO: 66075 - DNA, 70 bp, Artificial Sequence
  Synthetic
gccaagcatttaggtgacactatagatccatgttctttctaggatgtttcagagctatgctggaaacagc

SEQ ID NO: 66076 - DNA, 70 bp, Artificial Sequence
  Synthetic
gccaagcatttaggtgacactatagggcctccttttgatattcttgtttcagagctatgctggaaacagc

SEQ ID NO: 66077 - DNA, 70 bp, Artificial Sequence
  Synthetic
gccaagcatttaggtgacactatagcaataactttgttagcaggggtttcagagctatgctggaaacagc

SEQ ID NO: 66078 - DNA, 70 bp, Artificial Sequence
  Synthetic
gccaagcatttaggtgacactatagccagtagaatccggaaaattgtttcagagctatgctggaaacagc

SEQ ID NO: 66079 - DNA, 70 bp, Artificial Sequence
  Synthetic
gccaagcatttaggtgacactatagattgggcatgcgtcagtcaggtttcagagctatgctggaaacagc

SEQ ID NO: 66080 - DNA, 70 bp, Artificial Sequence
  Synthetic
gccaagcatttaggtgacactatagatgcgcttagcggggatgtcgtttcagagctatgctggaaacagc

SEQ ID NO: 66081 - DNA, 70 bp, Artificial Sequence
  Synthetic
gccaagcatttaggtgacactatagtgccctctctggtgacgtttgtttcagagctatgctggaaacagc

SEQ ID NO: 66082 - DNA, 70 bp, Artificial Sequence
  Synthetic
gccaagcatttaggtgacactatagaagggctggtcacttgctgtgtttcagagctatgctggaaacagc

SEQ ID NO: 66083 - DNA, 70 bp, Artificial Sequence
  Synthetic
gccaagcatttaggtgacactatagaaatggtgattataccggaagtttcagagctatgctggaaacagc

SEQ ID NO: 66084 - DNA, 70 bp, Artificial Sequence
  Synthetic
gccaagcatttaggtgacactatagtgtttctgagtggcagcaaggtttcagagctatgctggaaacagc

SEQ ID NO: 66085 - DNA, 70 bp, Artificial Sequence
  Synthetic
gccaagcatttaggtgacactatagcgctcctgcaagtgcagctggtttcagagctatgctggaaacagc

SEQ ID NO: 66086 - DNA, 70 bp, Artificial Sequence
  Synthetic
gccaagcatttaggtgacactatagccctgcttcctgaagctcttgtttcagagctatgctggaaacagc

SEQ ID NO: 66087 - DNA, 70 bp, Artificial Sequence
  Synthetic
gccaagcatttaggtgacactatagtttgccaatgtagtagagaagtttcagagctatgctggaaacagc

SEQ ID NO: 66088 - DNA, 70 bp, Artificial Sequence
  Synthetic
gccaagcatttaggtgacactatagccatgtgggcccagtctcacgtttcagagctatgctggaaacagc

SEQ ID NO: 66089 - DNA, 70 bp, Artificial Sequence
  Synthetic
gccaagcatttaggtgacactatagggagcagctctccaacatgggtttcagagctatgctggaaacagc

SEQ ID NO: 66090 - DNA, 70 bp, Artificial Sequence
  Synthetic
gccaagcatttaggtgacactatagacaagcatcagcgttttccagtttcagagctatgctggaaacagc

SEQ ID NO: 66091 - DNA, 70 bp, Artificial Sequence
  Synthetic
gccaagcatttaggtgacactatagtcgcaactcagtcaacaggagtttcagagctatgctggaaacagc

SEQ ID NO: 66092 - DNA, 70 bp, Artificial Sequence
  Synthetic
gccaagcatttaggtgacactatagcctgccccagaagagctattgtttcagagctatgctggaaacagc

SEQ ID NO: 66093 - DNA, 70 bp, Artificial Sequence
  Synthetic
gccaagcatttaggtgacactataggccttgctccagcagcagcagtttcagagctatgctggaaacagc

SEQ ID NO: 66094 - DNA, 70 bp, Artificial Sequence
  Synthetic
gccaagcatttaggtgacactatagcagcccaggaggtcccagtggtttcagagctatgctggaaacagc

SEQ ID NO: 66095 - DNA, 70 bp, Artificial Sequence
  Synthetic
gccaagcatttaggtgacactatagagcagcagagagaacggagagtttcagagctatgctggaaacagc

SEQ ID NO: 66096 - DNA, 70 bp, Artificial Sequence
  Synthetic
gccaagcatttaggtgacactataggctcatccagtcctggcactgtttcagagctatgctggaaacagc

SEQ ID NO: 66097 - DNA, 70 bp, Artificial Sequence
  Synthetic
gccaagcatttaggtgacactatagggctgcagagatggagcttcgtttcagagctatgctggaaacagc

SEQ ID NO: 66098 - DNA, 70 bp, Artificial Sequence
  Synthetic
gccaagcatttaggtgacactatagccttcttggcagatgcctacgtttcagagctatgctggaaacagc

SEQ ID NO: 66099 - DNA, 70 bp, Artificial Sequence
  Synthetic
gccaagcatttaggtgacactatagcttcttctctagctccagctgtttcagagctatgctggaaacagc

SEQ ID NO: 66100 - DNA, 70 bp, Artificial Sequence
  Synthetic
gccaagcatttaggtgacactatagtttctttggctgggctattcgtttcagagctatgctggaaacagc

SEQ ID NO: 66101 - DNA, 70 bp, Artificial Sequence
  Synthetic
gccaagcatttaggtgacactatagatccctatggcatctcgagggtttcagagctatgctggaaacagc

SEQ ID NO: 66102 - DNA, 70 bp, Artificial Sequence
  Synthetic
gccaagcatttaggtgacactataggggagcaggggtcccttagggtttcagagctatgctggaaacagc

SEQ ID NO: 66103 - DNA, 70 bp, Artificial Sequence
  Synthetic
gccaagcatttaggtgacactatagtggcggtcaacaaatgctccgtttcagagctatgctggaaacagc

SEQ ID NO: 66104 - DNA, 70 bp, Artificial Sequence
  Synthetic
gccaagcatttaggtgacactatagcatcgatgtagccgaatgaagtttcagagctatgctggaaacagc

SEQ ID NO: 66105 - DNA, 70 bp, Artificial Sequence
  Synthetic
gccaagcatttaggtgacactatagcagcatcagacaaggctactgtttcagagctatgctggaaacagc

SEQ ID NO: 66106 - DNA, 70 bp, Artificial Sequence
  Synthetic
gccaagcatttaggtgacactatagttaaggacattaagggttacgtttcagagctatgctggaaacagc

SEQ ID NO: 66107 - DNA, 70 bp, Artificial Sequence
  Synthetic
gccaagcatttaggtgacactataggtccctcatgatccatcactgtttcagagctatgctggaaacagc

SEQ ID NO: 66108 - DNA, 70 bp, Artificial Sequence
  Synthetic
gccaagcatttaggtgacactatagtggagggggtgatgtcaaacgtttcagagctatgctggaaacagc

SEQ ID NO: 66109 - DNA, 70 bp, Artificial Sequence
  Synthetic
gccaagcatttaggtgacactatagcatcttcgtcactgtggctggtttcagagctatgctggaaacagc

SEQ ID NO: 66110 - DNA, 70 bp, Artificial Sequence
  Synthetic
gccaagcatttaggtgacactatagacgagagcagcacaatccatgtttcagagctatgctggaaacagc

SEQ ID NO: 66111 - DNA, 70 bp, Artificial Sequence
  Synthetic
gccaagcatttaggtgacactatagggccagtgactaccaacgttgtttcagagctatgctggaaacagc

SEQ ID NO: 66112 - DNA, 70 bp, Artificial Sequence
  Synthetic
gccaagcatttaggtgacactatagtgacgttcatctttttccaggtttcagagctatgctggaaacagc

SEQ ID NO: 66113 - DNA, 70 bp, Artificial Sequence
  Synthetic
gccaagcatttaggtgacactatagaagaaatgctgatattgaccgtttcagagctatgctggaaacagc

SEQ ID NO: 66114 - DNA, 70 bp, Artificial Sequence
  Synthetic
gccaagcatttaggtgacactataggctgcatagttaggtttcaggtttcagagctatgctggaaacagc

SEQ ID NO: 66115 - DNA, 70 bp, Artificial Sequence
  Synthetic
gccaagcatttaggtgacactatagtgcgctgagtgccattggctgtttcagagctatgctggaaacagc

SEQ ID NO: 66116 - DNA, 70 bp, Artificial Sequence
  Synthetic
gccaagcatttaggtgacactatagaactcttccaagaacagaaggtttcagagctatgctggaaacagc

SEQ ID NO: 66117 - DNA, 70 bp, Artificial Sequence
  Synthetic
gccaagcatttaggtgacactataggggcgagtccactgtataacgtttcagagctatgctggaaacagc

SEQ ID NO: 66118 - DNA, 70 bp, Artificial Sequence
  Synthetic
gccaagcatttaggtgacactatagggtggaaaggaacacattaagtttcagagctatgctggaaacagc

SEQ ID NO: 66119 - DNA, 70 bp, Artificial Sequence
  Synthetic
gccaagcatttaggtgacactatagaaagacgacgtatcagaaaggtttcagagctatgctggaaacagc

SEQ ID NO: 66120 - DNA, 70 bp, Artificial Sequence
  Synthetic
gccaagcatttaggtgacactatagtttgtcttatatggctgtacgtttcagagctatgctggaaacagc

SEQ ID NO: 66121 - DNA, 70 bp, Artificial Sequence
  Synthetic
gccaagcatttaggtgacactatagaagaagcacggaatgtgaacgtttcagagctatgctggaaacagc

SEQ ID NO: 66122 - DNA, 70 bp, Artificial Sequence
  Synthetic
gccaagcatttaggtgacactatagtacagataattccgaaactggtttcagagctatgctggaaacagc

SEQ ID NO: 66123 - DNA, 70 bp, Artificial Sequence
  Synthetic
gccaagcatttaggtgacactatagtgccttaagcagtcttccttgtttcagagctatgctggaaacagc

SEQ ID NO: 66124 - DNA, 70 bp, Artificial Sequence
  Synthetic
gccaagcatttaggtgacactatagggggctcagctctgctgctcgtttcagagctatgctggaaacagc

SEQ ID NO: 66125 - DNA, 70 bp, Artificial Sequence
  Synthetic
gccaagcatttaggtgacactatagtgtggttgagtgaggagtgagtttcagagctatgctggaaacagc

SEQ ID NO: 66126 - DNA, 70 bp, Artificial Sequence
  Synthetic
gccaagcatttaggtgacactatagtccagaagctctaggtttacgtttcagagctatgctggaaacagc

SEQ ID NO: 66127 - DNA, 70 bp, Artificial Sequence
  Synthetic
gccaagcatttaggtgacactatagggcagctaaagcaggaaaacgtttcagagctatgctggaaacagc

SEQ ID NO: 66128 - DNA, 70 bp, Artificial Sequence
  Synthetic
gccaagcatttaggtgacactatagttgtcaggagagcatagaacgtttcagagctatgctggaaacagc

SEQ ID NO: 66129 - DNA, 70 bp, Artificial Sequence
  Synthetic
gccaagcatttaggtgacactataggagcagcagcatggcctgaggtttcagagctatgctggaaacagc

SEQ ID NO: 66130 - DNA, 70 bp, Artificial Sequence
  Synthetic
gccaagcatttaggtgacactatagactcggatccccagtgcatagtttcagagctatgctggaaacagc

SEQ ID NO: 66131 - DNA, 70 bp, Artificial Sequence
  Synthetic
gccaagcatttaggtgacactatagaggcatttgctaagtaacgagtttcagagctatgctggaaacagc

SEQ ID NO: 66132 - DNA, 70 bp, Artificial Sequence
  Synthetic
gccaagcatttaggtgacactataggacgccgcagagactctgaggtttcagagctatgctggaaacagc

SEQ ID NO: 66133 - DNA, 70 bp, Artificial Sequence
  Synthetic
gccaagcatttaggtgacactatagcctatgctggtggtagactagtttcagagctatgctggaaacagc

SEQ ID NO: 66134 - DNA, 70 bp, Artificial Sequence
  Synthetic
gccaagcatttaggtgacactatagacctacgctggcgggcggctgtttcagagctatgctggaaacagc

SEQ ID NO: 66135 - DNA, 70 bp, Artificial Sequence
  Synthetic
gccaagcatttaggtgacactatagctccagggaagggtgtgagggtttcagagctatgctggaaacagc

SEQ ID NO: 66136 - DNA, 70 bp, Artificial Sequence
  Synthetic
gccaagcatttaggtgacactatagtatcgaagcggtcgaaattcgtttcagagctatgctggaaacagc

SEQ ID NO: 66137 - DNA, 70 bp, Artificial Sequence
  Synthetic
gccaagcatttaggtgacactatagactgggagcggaggtcttaggtttcagagctatgctggaaacagc

SEQ ID NO: 66138 - DNA, 70 bp, Artificial Sequence
  Synthetic
gccaagcatttaggtgacactatagtctacatcctacacggttttgtttcagagctatgctggaaacagc

SEQ ID NO: 66139 - DNA, 70 bp, Artificial Sequence
  Synthetic
gccaagcatttaggtgacactatagacagtgttctcaaaggatctgtttcagagctatgctggaaacagc

SEQ ID NO: 66140 - DNA, 70 bp, Artificial Sequence
  Synthetic
gccaagcatttaggtgacactatagtgagaagaccctatactcaggtttcagagctatgctggaaacagc

SEQ ID NO: 66141 - DNA, 70 bp, Artificial Sequence
  Synthetic
gccaagcatttaggtgacactataggcaggcacagtgactgttacgtttcagagctatgctggaaacagc

SEQ ID NO: 66142 - DNA, 70 bp, Artificial Sequence
  Synthetic
gccaagcatttaggtgacactatagggtgtgaaggtggcggtcacgtttcagagctatgctggaaacagc

SEQ ID NO: 66143 - DNA, 70 bp, Artificial Sequence
  Synthetic
gccaagcatttaggtgacactatagctgctattgctgtggccccagtttcagagctatgctggaaacagc

SEQ ID NO: 66144 - DNA, 70 bp, Artificial Sequence
  Synthetic
gccaagcatttaggtgacactatagtggttcctccagcacttagagtttcagagctatgctggaaacagc

SEQ ID NO: 66145 - DNA, 70 bp, Artificial Sequence
  Synthetic
gccaagcatttaggtgacactatagatcctgcctttggggcttaggtttcagagctatgctggaaacagc

SEQ ID NO: 66146 - DNA, 70 bp, Artificial Sequence
  Synthetic
gccaagcatttaggtgacactatagctgtcttcatctagaatctcgtttcagagctatgctggaaacagc

SEQ ID NO: 66147 - DNA, 70 bp, Artificial Sequence
  Synthetic
gccaagcatttaggtgacactataggaatgtcttgaagagtcatggtttcagagctatgctggaaacagc

SEQ ID NO: 66148 - DNA, 70 bp, Artificial Sequence
  Synthetic
gccaagcatttaggtgacactatagctcaacacctcccagtagccgtttcagagctatgctggaaacagc

SEQ ID NO: 66149 - DNA, 70 bp, Artificial Sequence
  Synthetic
gccaagcatttaggtgacactataggatctccgcgggagtctcaggtttcagagctatgctggaaacagc

SEQ ID NO: 66150 - DNA, 70 bp, Artificial Sequence
  Synthetic
gccaagcatttaggtgacactataggtcagaggtggtggctgagcgtttcagagctatgctggaaacagc

SEQ ID NO: 66151 - DNA, 70 bp, Artificial Sequence
  Synthetic
gccaagcatttaggtgacactatagagtgcattaatcagattctcgtttcagagctatgctggaaacagc

SEQ ID NO: 66152 - DNA, 70 bp, Artificial Sequence
  Synthetic
gccaagcatttaggtgacactatagtcattatctgtgcttgtccggtttcagagctatgctggaaacagc

SEQ ID NO: 66153 - DNA, 70 bp, Artificial Sequence
  Synthetic
gccaagcatttaggtgacactataggcttcctaatgattcttgaggtttcagagctatgctggaaacagc

SEQ ID NO: 66154 - DNA, 70 bp, Artificial Sequence
  Synthetic
gccaagcatttaggtgacactatagtctgcgcgggagatcagcgagtttcagagctatgctggaaacagc

SEQ ID NO: 66155 - DNA, 70 bp, Artificial Sequence
  Synthetic
gccaagcatttaggtgacactataggggtgtcgtcagagatcagagtttcagagctatgctggaaacagc

SEQ ID NO: 66156 - DNA, 70 bp, Artificial Sequence
  Synthetic
gccaagcatttaggtgacactatagacagatcctaagccatagacgtttcagagctatgctggaaacagc

SEQ ID NO: 66157 - DNA, 70 bp, Artificial Sequence
  Synthetic
gccaagcatttaggtgacactatagcccgagccgcaggtctgctggtttcagagctatgctggaaacagc

SEQ ID NO: 66158 - DNA, 70 bp, Artificial Sequence
  Synthetic
gccaagcatttaggtgacactatagaatctgtctcaggaagggtagtttcagagctatgctggaaacagc

SEQ ID NO: 66159 - DNA, 70 bp, Artificial Sequence
  Synthetic
gccaagcatttaggtgacactataggagcagaagggtcaggaagcgtttcagagctatgctggaaacagc

SEQ ID NO: 66160 - DNA, 70 bp, Artificial Sequence
  Synthetic
gccaagcatttaggtgacactatagcctcgaggtctttgaggatcgtttcagagctatgctggaaacagc

SEQ ID NO: 66161 - DNA, 70 bp, Artificial Sequence
  Synthetic
gccaagcatttaggtgacactatagttctggggggcttcagggaggtttcagagctatgctggaaacagc

SEQ ID NO: 66162 - DNA, 70 bp, Artificial Sequence
  Synthetic
gccaagcatttaggtgacactatagcgtcaagggtggcccctactgtttcagagctatgctggaaacagc

SEQ ID NO: 66163 - DNA, 70 bp, Artificial Sequence
  Synthetic
gccaagcatttaggtgacactatagtttgttcttggaagtgttcggtttcagagctatgctggaaacagc

SEQ ID NO: 66164 - DNA, 70 bp, Artificial Sequence
  Synthetic
gccaagcatttaggtgacactatagaggaaatgacgggacaagttgtttcagagctatgctggaaacagc

SEQ ID NO: 66165 - DNA, 70 bp, Artificial Sequence
  Synthetic
gccaagcatttaggtgacactatagtacacttagcgtggagaagcgtttcagagctatgctggaaacagc

SEQ ID NO: 66166 - DNA, 70 bp, Artificial Sequence
  Synthetic
gccaagcatttaggtgacactatagaggagtgttatctgctccccgtttcagagctatgctggaaacagc

SEQ ID NO: 66167 - DNA, 70 bp, Artificial Sequence
  Synthetic
gccaagcatttaggtgacactatagcatgtcggcatctccatcatgtttcagagctatgctggaaacagc

SEQ ID NO: 66168 - DNA, 70 bp, Artificial Sequence
  Synthetic
gccaagcatttaggtgacactatagcatgtctaagtctccatcgtgtttcagagctatgctggaaacagc

SEQ ID NO: 66169 - DNA, 70 bp, Artificial Sequence
  Synthetic
gccaagcatttaggtgacactatagctgaccactgcctgggctaggtttcagagctatgctggaaacagc

SEQ ID NO: 66170 - DNA, 70 bp, Artificial Sequence
  Synthetic
gccaagcatttaggtgacactatagctgtagatacacaatcagctgtttcagagctatgctggaaacagc

SEQ ID NO: 66171 - DNA, 70 bp, Artificial Sequence
  Synthetic
gccaagcatttaggtgacactatagatttgacttggatccttctggtttcagagctatgctggaaacagc

SEQ ID NO: 66172 - DNA, 70 bp, Artificial Sequence
  Synthetic
gccaagcatttaggtgacactatagctagactgcaaatgcacatggtttcagagctatgctggaaacagc

SEQ ID NO: 66173 - DNA, 70 bp, Artificial Sequence
  Synthetic
gccaagcatttaggtgacactataggcactcttctggactgtagcgtttcagagctatgctggaaacagc

SEQ ID NO: 66174 - DNA, 70 bp, Artificial Sequence
  Synthetic
gccaagcatttaggtgacactatagtcaacactttctgaaggcaagtttcagagctatgctggaaacagc

SEQ ID NO: 66175 - DNA, 70 bp, Artificial Sequence
  Synthetic
gccaagcatttaggtgacactatagttggatggaaagcagacttggtttcagagctatgctggaaacagc

SEQ ID NO: 66176 - DNA, 70 bp, Artificial Sequence
  Synthetic
gccaagcatttaggtgacactatagacggagaaagaggaactcttgtttcagagctatgctggaaacagc

SEQ ID NO: 66177 - DNA, 70 bp, Artificial Sequence
  Synthetic
gccaagcatttaggtgacactatagccatgggccccaccagtcacgtttcagagctatgctggaaacagc

SEQ ID NO: 66178 - DNA, 70 bp, Artificial Sequence
  Synthetic
gccaagcatttaggtgacactataggcaaagaggacaaccctaaggtttcagagctatgctggaaacagc

SEQ ID NO: 66179 - DNA, 70 bp, Artificial Sequence
  Synthetic
gccaagcatttaggtgacactatagcagcagtatctcagttaactgtttcagagctatgctggaaacagc

SEQ ID NO: 66180 - DNA, 70 bp, Artificial Sequence
  Synthetic
gccaagcatttaggtgacactatagaccgtagcttgtagttagccgtttcagagctatgctggaaacagc

SEQ ID NO: 66181 - DNA, 70 bp, Artificial Sequence
  Synthetic
gccaagcatttaggtgacactatagaggatattcatttgttcggtgtttcagagctatgctggaaacagc

SEQ ID NO: 66182 - DNA, 70 bp, Artificial Sequence
  Synthetic
gccaagcatttaggtgacactatagattctggagtccttattcacgtttcagagctatgctggaaacagc

SEQ ID NO: 66183 - DNA, 70 bp, Artificial Sequence
  Synthetic
gccaagcatttaggtgacactatagtgagatcaccaacaaagacagtttcagagctatgctggaaacagc

SEQ ID NO: 66184 - DNA, 70 bp, Artificial Sequence
  Synthetic
gccaagcatttaggtgacactatagtgagctcagtgagaagtgcagtttcagagctatgctggaaacagc

SEQ ID NO: 66185 - DNA, 70 bp, Artificial Sequence
  Synthetic
gccaagcatttaggtgacactatagttggagaagaaaaggaaatggtttcagagctatgctggaaacagc

SEQ ID NO: 66186 - DNA, 70 bp, Artificial Sequence
  Synthetic
gccaagcatttaggtgacactatagagagggaaggcttggggttggtttcagagctatgctggaaacagc

SEQ ID NO: 66187 - DNA, 70 bp, Artificial Sequence
  Synthetic
gccaagcatttaggtgacactatagagttaccaaacacagtgagcgtttcagagctatgctggaaacagc

SEQ ID NO: 66188 - DNA, 70 bp, Artificial Sequence
  Synthetic
gccaagcatttaggtgacactataggatctcagtgttcagtttccgtttcagagctatgctggaaacagc

SEQ ID NO: 66189 - DNA, 70 bp, Artificial Sequence
  Synthetic
gccaagcatttaggtgacactatagttttatgaaacagagagccagtttcagagctatgctggaaacagc

SEQ ID NO: 66190 - DNA, 70 bp, Artificial Sequence
  Synthetic
gccaagcatttaggtgacactataggcccgaggacaagacgcagggtttcagagctatgctggaaacagc

SEQ ID NO: 66191 - DNA, 70 bp, Artificial Sequence
  Synthetic
gccaagcatttaggtgacactataggccttagaggaagaaagtcggtttcagagctatgctggaaacagc

SEQ ID NO: 66192 - DNA, 70 bp, Artificial Sequence
  Synthetic
gccaagcatttaggtgacactataggctcatgggaacctggctgggtttcagagctatgctggaaacagc

SEQ ID NO: 66193 - DNA, 70 bp, Artificial Sequence
  Synthetic
gccaagcatttaggtgacactatagcattgatgccacagctgagggtttcagagctatgctggaaacagc

SEQ ID NO: 66194 - DNA, 70 bp, Artificial Sequence
  Synthetic
gccaagcatttaggtgacactatagaagcagttctccgacagaaagtttcagagctatgctggaaacagc

SEQ ID NO: 66195 - DNA, 70 bp, Artificial Sequence
  Synthetic
gccaagcatttaggtgacactatagggcagcctccccctggttcagtttcagagctatgctggaaacagc

SEQ ID NO: 66196 - DNA, 70 bp, Artificial Sequence
  Synthetic
gccaagcatttaggtgacactatagggactgactgaaactcgctagtttcagagctatgctggaaacagc

SEQ ID NO: 66197 - DNA, 70 bp, Artificial Sequence
  Synthetic
gccaagcatttaggtgacactatagtgattatcaatctgagccttgtttcagagctatgctggaaacagc

SEQ ID NO: 66198 - DNA, 70 bp, Artificial Sequence
  Synthetic
gccaagcatttaggtgacactatagaattggtattaaggaggcttgtttcagagctatgctggaaacagc

SEQ ID NO: 66199 - DNA, 70 bp, Artificial Sequence
  Synthetic
gccaagcatttaggtgacactatagagcagtgaaggcgccttcatgtttcagagctatgctggaaacagc

SEQ ID NO: 66200 - DNA, 70 bp, Artificial Sequence
  Synthetic
gccaagcatttaggtgacactatagccctttaccatcaaaatctggtttcagagctatgctggaaacagc

SEQ ID NO: 66201 - DNA, 70 bp, Artificial Sequence
  Synthetic
gccaagcatttaggtgacactatagccctatgacggtgtgtgaccgtttcagagctatgctggaaacagc

SEQ ID NO: 66202 - DNA, 70 bp, Artificial Sequence
  Synthetic
gccaagcatttaggtgacactatagtcctgcattattttgtttgggtttcagagctatgctggaaacagc

SEQ ID NO: 66203 - DNA, 70 bp, Artificial Sequence
  Synthetic
gccaagcatttaggtgacactatagttcagtgggccttcaacttcgtttcagagctatgctggaaacagc

SEQ ID NO: 66204 - DNA, 70 bp, Artificial Sequence
  Synthetic
gccaagcatttaggtgacactatagtgcagcttcttcacagagacgtttcagagctatgctggaaacagc

SEQ ID NO: 66205 - DNA, 70 bp, Artificial Sequence
  Synthetic
gccaagcatttaggtgacactatagacatgctactgcgttgttaggtttcagagctatgctggaaacagc

SEQ ID NO: 66206 - DNA, 70 bp, Artificial Sequence
  Synthetic
gccaagcatttaggtgacactatagataccagattgaggatgatggtttcagagctatgctggaaacagc

SEQ ID NO: 66207 - DNA, 70 bp, Artificial Sequence
  Synthetic
gccaagcatttaggtgacactatagtactgacagggacctcatgcgtttcagagctatgctggaaacagc

SEQ ID NO: 66208 - DNA, 70 bp, Artificial Sequence
  Synthetic
gccaagcatttaggtgacactatagtccgaggaagagaaactgaagtttcagagctatgctggaaacagc

SEQ ID NO: 66209 - DNA, 70 bp, Artificial Sequence
  Synthetic
gccaagcatttaggtgacactatagggaacgagccaacatgtgacgtttcagagctatgctggaaacagc

SEQ ID NO: 66210 - DNA, 70 bp, Artificial Sequence
  Synthetic
gccaagcatttaggtgacactatagagactatcgacaatatcagtgtttcagagctatgctggaaacagc

SEQ ID NO: 66211 - DNA, 70 bp, Artificial Sequence
  Synthetic
gccaagcatttaggtgacactatagggtggcagtggcttcctcaggtttcagagctatgctggaaacagc

SEQ ID NO: 66212 - DNA, 70 bp, Artificial Sequence
  Synthetic
gccaagcatttaggtgacactatagaaatcatattcaccacttccgtttcagagctatgctggaaacagc

SEQ ID NO: 66213 - DNA, 70 bp, Artificial Sequence
  Synthetic
gccaagcatttaggtgacactatagctgcaggcaattactctcacgtttcagagctatgctggaaacagc

SEQ ID NO: 66214 - DNA, 70 bp, Artificial Sequence
  Synthetic
gccaagcatttaggtgacactatagaaaatcttcagagtgactgtgtttcagagctatgctggaaacagc

SEQ ID NO: 66215 - DNA, 70 bp, Artificial Sequence
  Synthetic
gccaagcatttaggtgacactatagccgttctgtgtgctgctgtcgtttcagagctatgctggaaacagc

SEQ ID NO: 66216 - DNA, 70 bp, Artificial Sequence
  Synthetic
gccaagcatttaggtgacactatagggggcctcagggtttcatctgtttcagagctatgctggaaacagc

SEQ ID NO: 66217 - DNA, 70 bp, Artificial Sequence
  Synthetic
gccaagcatttaggtgacactatagccacactcagagaatctgctgtttcagagctatgctggaaacagc

SEQ ID NO: 66218 - DNA, 70 bp, Artificial Sequence
  Synthetic
gccaagcatttaggtgacactataggcccagagttcagggctgttgtttcagagctatgctggaaacagc

SEQ ID NO: 66219 - DNA, 70 bp, Artificial Sequence
  Synthetic
gccaagcatttaggtgacactataggcgtcctcttgcatcctgaggtttcagagctatgctggaaacagc

SEQ ID NO: 66220 - DNA, 70 bp, Artificial Sequence
  Synthetic
gccaagcatttaggtgacactatagaatgctgagatcagtcagaagtttcagagctatgctggaaacagc

SEQ ID NO: 66221 - DNA, 70 bp, Artificial Sequence
  Synthetic
gccaagcatttaggtgacactatagctcccatccggctaggccacgtttcagagctatgctggaaacagc

SEQ ID NO: 66222 - DNA, 70 bp, Artificial Sequence
  Synthetic
gccaagcatttaggtgacactatagtgtacagaaaggagggcagtgtttcagagctatgctggaaacagc

SEQ ID NO: 66223 - DNA, 70 bp, Artificial Sequence
  Synthetic
gccaagcatttaggtgacactatagccatcaggacttctctatcggtttcagagctatgctggaaacagc

SEQ ID NO: 66224 - DNA, 70 bp, Artificial Sequence
  Synthetic
gccaagcatttaggtgacactatagtctattactgaagggtttctgtttcagagctatgctggaaacagc

SEQ ID NO: 66225 - DNA, 70 bp, Artificial Sequence
  Synthetic
gccaagcatttaggtgacactatagcgggcaggattcaggctatcgtttcagagctatgctggaaacagc

SEQ ID NO: 66226 - DNA, 70 bp, Artificial Sequence
  Synthetic
gccaagcatttaggtgacactataggacatcgaggacccataagcgtttcagagctatgctggaaacagc

SEQ ID NO: 66227 - DNA, 70 bp, Artificial Sequence
  Synthetic
gccaagcatttaggtgacactataggggcagggtctggcgctcaggtttcagagctatgctggaaacagc

SEQ ID NO: 66228 - DNA, 70 bp, Artificial Sequence
  Synthetic
gccaagcatttaggtgacactataggacatcgttcagccctagtagtttcagagctatgctggaaacagc

SEQ ID NO: 66229 - DNA, 70 bp, Artificial Sequence
  Synthetic
gccaagcatttaggtgacactataggttcatcagaactcgtcagtgtttcagagctatgctggaaacagc

SEQ ID NO: 66230 - DNA, 70 bp, Artificial Sequence
  Synthetic
gccaagcatttaggtgacactataggaggacatgggtcatcactggtttcagagctatgctggaaacagc

SEQ ID NO: 66231 - DNA, 70 bp, Artificial Sequence
  Synthetic
gccaagcatttaggtgacactatagagaactgtctctacagtcacgtttcagagctatgctggaaacagc

SEQ ID NO: 66232 - DNA, 70 bp, Artificial Sequence
  Synthetic
gccaagcatttaggtgacactatagcacagagcaaaaggagtgaggtttcagagctatgctggaaacagc

SEQ ID NO: 66233 - DNA, 70 bp, Artificial Sequence
  Synthetic
gccaagcatttaggtgacactatagtgacctttatgactcttgtggtttcagagctatgctggaaacagc

SEQ ID NO: 66234 - DNA, 70 bp, Artificial Sequence
  Synthetic
gccaagcatttaggtgacactatagaaatgaagaggaaacactgcgtttcagagctatgctggaaacagc

SEQ ID NO: 66235 - DNA, 70 bp, Artificial Sequence
  Synthetic
gccaagcatttaggtgacactataggaggatgaacttcatgatcagtttcagagctatgctggaaacagc

SEQ ID NO: 66236 - DNA, 70 bp, Artificial Sequence
  Synthetic
gccaagcatttaggtgacactataggtacttttttgtgagtctgcgtttcagagctatgctggaaacagc

SEQ ID NO: 66237 - DNA, 70 bp, Artificial Sequence
  Synthetic
gccaagcatttaggtgacactatagacaggagggagaaggggaacgtttcagagctatgctggaaacagc

SEQ ID NO: 66238 - DNA, 70 bp, Artificial Sequence
  Synthetic
gccaagcatttaggtgacactatagacttgacgaaagccaccatcgtttcagagctatgctggaaacagc

SEQ ID NO: 66239 - DNA, 70 bp, Artificial Sequence
  Synthetic
gccaagcatttaggtgacactatagcagggcaacctgctcaactagtttcagagctatgctggaaacagc

SEQ ID NO: 66240 - DNA, 70 bp, Artificial Sequence
  Synthetic
gccaagcatttaggtgacactatagggagatccaaattatctcgtgtttcagagctatgctggaaacagc

SEQ ID NO: 66241 - DNA, 70 bp, Artificial Sequence
  Synthetic
gccaagcatttaggtgacactatagacatctataattctgtgtccgtttcagagctatgctggaaacagc

SEQ ID NO: 66242 - DNA, 70 bp, Artificial Sequence
  Synthetic
gccaagcatttaggtgacactatagggcagccttcgagaggtcacgtttcagagctatgctggaaacagc

SEQ ID NO: 66243 - DNA, 70 bp, Artificial Sequence
  Synthetic
gccaagcatttaggtgacactataggccctcgcaggtccctcagtgtttcagagctatgctggaaacagc

SEQ ID NO: 66244 - DNA, 70 bp, Artificial Sequence
  Synthetic
gccaagcatttaggtgacactatagatagaccttttgcctcctatgtttcagagctatgctggaaacagc

SEQ ID NO: 66245 - DNA, 70 bp, Artificial Sequence
  Synthetic
gccaagcatttaggtgacactatagccccatggcagcccctgttcgtttcagagctatgctggaaacagc

SEQ ID NO: 66246 - DNA, 70 bp, Artificial Sequence
  Synthetic
gccaagcatttaggtgacactataggggtgtgggagcaggttcaagtttcagagctatgctggaaacagc

SEQ ID NO: 66247 - DNA, 70 bp, Artificial Sequence
  Synthetic
gccaagcatttaggtgacactatagtcttcagtttgtgagtgcaggtttcagagctatgctggaaacagc

SEQ ID NO: 66248 - DNA, 70 bp, Artificial Sequence
  Synthetic
gccaagcatttaggtgacactatagttggaggtcttgcagagctagtttcagagctatgctggaaacagc

SEQ ID NO: 66249 - DNA, 70 bp, Artificial Sequence
  Synthetic
gccaagcatttaggtgacactatagttggtcacacatagcacagtgtttcagagctatgctggaaacagc

SEQ ID NO: 66250 - DNA, 70 bp, Artificial Sequence
  Synthetic
gccaagcatttaggtgacactatagctcatcaccaaggcctaggggtttcagagctatgctggaaacagc

SEQ ID NO: 66251 - DNA, 70 bp, Artificial Sequence
  Synthetic
gccaagcatttaggtgacactataggttcagcaacatgcatttcagtttcagagctatgctggaaacagc

SEQ ID NO: 66252 - DNA, 70 bp, Artificial Sequence
  Synthetic
gccaagcatttaggtgacactatagtacggctgctataatgtgtcgtttcagagctatgctggaaacagc

SEQ ID NO: 66253 - DNA, 70 bp, Artificial Sequence
  Synthetic
gccaagcatttaggtgacactatagcaagttcttgactgagtgaggtttcagagctatgctggaaacagc

SEQ ID NO: 66254 - DNA, 70 bp, Artificial Sequence
  Synthetic
gccaagcatttaggtgacactatagtggcttctctctagtctttcgtttcagagctatgctggaaacagc

SEQ ID NO: 66255 - DNA, 70 bp, Artificial Sequence
  Synthetic
gccaagcatttaggtgacactataggaagtcccggacgatgaatggtttcagagctatgctggaaacagc

SEQ ID NO: 66256 - DNA, 70 bp, Artificial Sequence
  Synthetic
gccaagcatttaggtgacactataggcatccaggagctggaggctgtttcagagctatgctggaaacagc

SEQ ID NO: 66257 - DNA, 70 bp, Artificial Sequence
  Synthetic
gccaagcatttaggtgacactatagcactggctcgggggacaagagtttcagagctatgctggaaacagc

SEQ ID NO: 66258 - DNA, 70 bp, Artificial Sequence
  Synthetic
gccaagcatttaggtgacactataggaaggccaccgtgtatgagggtttcagagctatgctggaaacagc

SEQ ID NO: 66259 - DNA, 70 bp, Artificial Sequence
  Synthetic
gccaagcatttaggtgacactatagttctggagatgtcacaactcgtttcagagctatgctggaaacagc

SEQ ID NO: 66260 - DNA, 70 bp, Artificial Sequence
  Synthetic
gccaagcatttaggtgacactatagcaagaaggccacagtttatggtttcagagctatgctggaaacagc

SEQ ID NO: 66261 - DNA, 70 bp, Artificial Sequence
  Synthetic
gccaagcatttaggtgacactatagcactggctctggggataagagtttcagagctatgctggaaacagc

SEQ ID NO: 66262 - DNA, 70 bp, Artificial Sequence
  Synthetic
gccaagcatttaggtgacactataggtaccagatcacctactgaggtttcagagctatgctggaaacagc

SEQ ID NO: 66263 - DNA, 70 bp, Artificial Sequence
  Synthetic
gccaagcatttaggtgacactatagatgcttgaagaagggggtgtgtttcagagctatgctggaaacagc

SEQ ID NO: 66264 - DNA, 70 bp, Artificial Sequence
  Synthetic
gccaagcatttaggtgacactatagactgttattggacgccccaggtttcagagctatgctggaaacagc

SEQ ID NO: 66265 - DNA, 70 bp, Artificial Sequence
  Synthetic
gccaagcatttaggtgacactatagttctgtgaccccaggggagagtttcagagctatgctggaaacagc

SEQ ID NO: 66266 - DNA, 70 bp, Artificial Sequence
  Synthetic
gccaagcatttaggtgacactatagtttttggtatgtgtggtatcgtttcagagctatgctggaaacagc

SEQ ID NO: 66267 - DNA, 70 bp, Artificial Sequence
  Synthetic
gccaagcatttaggtgacactatagagcactatttcttcatgtgcgtttcagagctatgctggaaacagc

SEQ ID NO: 66268 - DNA, 70 bp, Artificial Sequence
  Synthetic
gccaagcatttaggtgacactatagtgctcatctcgaagctctgagtttcagagctatgctggaaacagc

SEQ ID NO: 66269 - DNA, 70 bp, Artificial Sequence
  Synthetic
gccaagcatttaggtgacactatagtgagggaagatgagggctaagtttcagagctatgctggaaacagc

SEQ ID NO: 66270 - DNA, 70 bp, Artificial Sequence
  Synthetic
gccaagcatttaggtgacactatagggggtgctaattcacagaatgtttcagagctatgctggaaacagc

SEQ ID NO: 66271 - DNA, 70 bp, Artificial Sequence
  Synthetic
gccaagcatttaggtgacactataggccttttttgggctaacttagtttcagagctatgctggaaacagc

SEQ ID NO: 66272 - DNA, 70 bp, Artificial Sequence
  Synthetic
gccaagcatttaggtgacactataggagttaaatgaagagtctcggtttcagagctatgctggaaacagc

SEQ ID NO: 66273 - DNA, 70 bp, Artificial Sequence
  Synthetic
gccaagcatttaggtgacactataggagagctgcgataaagtcctgtttcagagctatgctggaaacagc

SEQ ID NO: 66274 - DNA, 70 bp, Artificial Sequence
  Synthetic
gccaagcatttaggtgacactatagccagttcagaaagaacggatgtttcagagctatgctggaaacagc

SEQ ID NO: 66275 - DNA, 70 bp, Artificial Sequence
  Synthetic
gccaagcatttaggtgacactataggaagcaacatctatctgaaggtttcagagctatgctggaaacagc

SEQ ID NO: 66276 - DNA, 70 bp, Artificial Sequence
  Synthetic
gccaagcatttaggtgacactatagttgctcctttgattaggagagtttcagagctatgctggaaacagc

SEQ ID NO: 66277 - DNA, 70 bp, Artificial Sequence
  Synthetic
gccaagcatttaggtgacactatagaagcaaacgtgggctcttttgtttcagagctatgctggaaacagc

SEQ ID NO: 66278 - DNA, 70 bp, Artificial Sequence
  Synthetic
gccaagcatttaggtgacactatagtagtcaggtgttcaaggaaagtttcagagctatgctggaaacagc

SEQ ID NO: 66279 - DNA, 70 bp, Artificial Sequence
  Synthetic
gccaagcatttaggtgacactatagttggcaaactctgagaaatggtttcagagctatgctggaaacagc

SEQ ID NO: 66280 - DNA, 70 bp, Artificial Sequence
  Synthetic
gccaagcatttaggtgacactataggattccggctcacggctattgtttcagagctatgctggaaacagc

SEQ ID NO: 66281 - DNA, 70 bp, Artificial Sequence
  Synthetic
gccaagcatttaggtgacactatagagaaccggcggacaaagtgggtttcagagctatgctggaaacagc

SEQ ID NO: 66282 - DNA, 70 bp, Artificial Sequence
  Synthetic
gccaagcatttaggtgacactataggaatgggcaggctcactcgcgtttcagagctatgctggaaacagc

SEQ ID NO: 66283 - DNA, 70 bp, Artificial Sequence
  Synthetic
gccaagcatttaggtgacactataggggcgtcgctcacaccaccggtttcagagctatgctggaaacagc

SEQ ID NO: 66284 - DNA, 70 bp, Artificial Sequence
  Synthetic
gccaagcatttaggtgacactatagcgcgctggtgggctcacaccgtttcagagctatgctggaaacagc

SEQ ID NO: 66285 - DNA, 70 bp, Artificial Sequence
  Synthetic
gccaagcatttaggtgacactatagaatactcagtcttgtaagtcgtttcagagctatgctggaaacagc

SEQ ID NO: 66286 - DNA, 70 bp, Artificial Sequence
  Synthetic
gccaagcatttaggtgacactatagtgccaagtgatggcagcaacgtttcagagctatgctggaaacagc

SEQ ID NO: 66287 - DNA, 70 bp, Artificial Sequence
  Synthetic
gccaagcatttaggtgacactatagatgtacaaagagccatctgcgtttcagagctatgctggaaacagc

SEQ ID NO: 66288 - DNA, 70 bp, Artificial Sequence
  Synthetic
gccaagcatttaggtgacactatagcttcatgttcagctcactgtgtttcagagctatgctggaaacagc

SEQ ID NO: 66289 - DNA, 70 bp, Artificial Sequence
  Synthetic
gccaagcatttaggtgacactatagggagtgcttggaggcatatggtttcagagctatgctggaaacagc

SEQ ID NO: 66290 - DNA, 70 bp, Artificial Sequence
  Synthetic
gccaagcatttaggtgacactatagcaactatccaagatactgtggtttcagagctatgctggaaacagc

SEQ ID NO: 66291 - DNA, 70 bp, Artificial Sequence
  Synthetic
gccaagcatttaggtgacactatagcagcctctgcgagaagtgacgtttcagagctatgctggaaacagc

SEQ ID NO: 66292 - DNA, 70 bp, Artificial Sequence
  Synthetic
gccaagcatttaggtgacactatagattactccagggatacctaagtttcagagctatgctggaaacagc

SEQ ID NO: 66293 - DNA, 70 bp, Artificial Sequence
  Synthetic
gccaagcatttaggtgacactatagggtttccttggctgtctgtggtttcagagctatgctggaaacagc

SEQ ID NO: 66294 - DNA, 70 bp, Artificial Sequence
  Synthetic
gccaagcatttaggtgacactataggctcatctcggaggtttaaagtttcagagctatgctggaaacagc

SEQ ID NO: 66295 - DNA, 70 bp, Artificial Sequence
  Synthetic
gccaagcatttaggtgacactatagcggtcagtggagcctcagtggtttcagagctatgctggaaacagc

SEQ ID NO: 66296 - DNA, 70 bp, Artificial Sequence
  Synthetic
gccaagcatttaggtgacactatagaacaaaggcagaagaaaaaggtttcagagctatgctggaaacagc

SEQ ID NO: 66297 - DNA, 70 bp, Artificial Sequence
  Synthetic
gccaagcatttaggtgacactatagcaatgtgatgtcaggcatccgtttcagagctatgctggaaacagc

SEQ ID NO: 66298 - DNA, 70 bp, Artificial Sequence
  Synthetic
gccaagcatttaggtgacactatagcactctccagcaaggcacgggtttcagagctatgctggaaacagc

SEQ ID NO: 66299 - DNA, 70 bp, Artificial Sequence
  Synthetic
gccaagcatttaggtgacactatagtctctcaatgctgcttcttggtttcagagctatgctggaaacagc

SEQ ID NO: 66300 - DNA, 70 bp, Artificial Sequence
  Synthetic
gccaagcatttaggtgacactatagatgccctacatctactgaaggtttcagagctatgctggaaacagc

SEQ ID NO: 66301 - DNA, 70 bp, Artificial Sequence
  Synthetic
gccaagcatttaggtgacactatagctgggcatctacagaagcaagtttcagagctatgctggaaacagc

SEQ ID NO: 66302 - DNA, 70 bp, Artificial Sequence
  Synthetic
gccaagcatttaggtgacactatagacagaactcagtccatcttggtttcagagctatgctggaaacagc

SEQ ID NO: 66303 - DNA, 70 bp, Artificial Sequence
  Synthetic
gccaagcatttaggtgacactatagattccatggctattactgtcgtttcagagctatgctggaaacagc

SEQ ID NO: 66304 - DNA, 70 bp, Artificial Sequence
  Synthetic
gccaagcatttaggtgacactatagttggcttctttgcatgctttgtttcagagctatgctggaaacagc

SEQ ID NO: 66305 - DNA, 70 bp, Artificial Sequence
  Synthetic
gccaagcatttaggtgacactatagacagccttggggataatgtggtttcagagctatgctggaaacagc

SEQ ID NO: 66306 - DNA, 70 bp, Artificial Sequence
  Synthetic
gccaagcatttaggtgacactatagtgctgtgaagatagactgatgtttcagagctatgctggaaacagc

SEQ ID NO: 66307 - DNA, 70 bp, Artificial Sequence
  Synthetic
gccaagcatttaggtgacactatagagatgaggaaatgactgcaggtttcagagctatgctggaaacagc

SEQ ID NO: 66308 - DNA, 70 bp, Artificial Sequence
  Synthetic
gccaagcatttaggtgacactatagacaggtggaattaagaaatcgtttcagagctatgctggaaacagc

SEQ ID NO: 66309 - DNA, 70 bp, Artificial Sequence
  Synthetic
gccaagcatttaggtgacactataggccgcggggaaggggcccttgtttcagagctatgctggaaacagc

SEQ ID NO: 66310 - DNA, 70 bp, Artificial Sequence
  Synthetic
gccaagcatttaggtgacactatagctgatgggggatcgcaattagtttcagagctatgctggaaacagc

SEQ ID NO: 66311 - DNA, 70 bp, Artificial Sequence
  Synthetic
gccaagcatttaggtgacactataggaattgtgctcctggtgactgtttcagagctatgctggaaacagc

SEQ ID NO: 66312 - DNA, 70 bp, Artificial Sequence
  Synthetic
gccaagcatttaggtgacactatagatttcagcaaatttggagcagtttcagagctatgctggaaacagc

SEQ ID NO: 66313 - DNA, 70 bp, Artificial Sequence
  Synthetic
gccaagcatttaggtgacactatagcctgcacctgttacggtttcgtttcagagctatgctggaaacagc

SEQ ID NO: 66314 - DNA, 70 bp, Artificial Sequence
  Synthetic
gccaagcatttaggtgacactataggatcctggccatgaatgaaagtttcagagctatgctggaaacagc

SEQ ID NO: 66315 - DNA, 70 bp, Artificial Sequence
  Synthetic
gccaagcatttaggtgacactataggctctcaggatacttattacgtttcagagctatgctggaaacagc

SEQ ID NO: 66316 - DNA, 70 bp, Artificial Sequence
  Synthetic
gccaagcatttaggtgacactatagcctggagtcctagccatcaggtttcagagctatgctggaaacagc

SEQ ID NO: 66317 - DNA, 70 bp, Artificial Sequence
  Synthetic
gccaagcatttaggtgacactataggcaggagctgaccgtggatcgtttcagagctatgctggaaacagc

SEQ ID NO: 66318 - DNA, 70 bp, Artificial Sequence
  Synthetic
gccaagcatttaggtgacactatagggctgcgggggtcaaagagcgtttcagagctatgctggaaacagc

SEQ ID NO: 66319 - DNA, 70 bp, Artificial Sequence
  Synthetic
gccaagcatttaggtgacactatagcaaaagagtcatcaggccctgtttcagagctatgctggaaacagc

SEQ ID NO: 66320 - DNA, 70 bp, Artificial Sequence
  Synthetic
gccaagcatttaggtgacactatagagatgaacaggatgcctagggtttcagagctatgctggaaacagc

SEQ ID NO: 66321 - DNA, 70 bp, Artificial Sequence
  Synthetic
gccaagcatttaggtgacactatagcagaagcccaaagggacatggtttcagagctatgctggaaacagc

SEQ ID NO: 66322 - DNA, 70 bp, Artificial Sequence
  Synthetic
gccaagcatttaggtgacactatagtgaattaatgaagctggacggtttcagagctatgctggaaacagc

SEQ ID NO: 66323 - DNA, 70 bp, Artificial Sequence
  Synthetic
gccaagcatttaggtgacactatagattccgcttccccagcggcggtttcagagctatgctggaaacagc

SEQ ID NO: 66324 - DNA, 70 bp, Artificial Sequence
  Synthetic
gccaagcatttaggtgacactatagcttctgtgccagcatcatctgtttcagagctatgctggaaacagc

SEQ ID NO: 66325 - DNA, 70 bp, Artificial Sequence
  Synthetic
gccaagcatttaggtgacactatagcgtgttgctgcccagctgaggtttcagagctatgctggaaacagc

SEQ ID NO: 66326 - DNA, 70 bp, Artificial Sequence
  Synthetic
gccaagcatttaggtgacactatagaggaaccagtggcttcatctgtttcagagctatgctggaaacagc

SEQ ID NO: 66327 - DNA, 70 bp, Artificial Sequence
  Synthetic
gccaagcatttaggtgacactataggttcaagagaacttcccagagtttcagagctatgctggaaacagc

SEQ ID NO: 66328 - DNA, 70 bp, Artificial Sequence
  Synthetic
gccaagcatttaggtgacactatagggagtccatcacatttcaaagtttcagagctatgctggaaacagc

SEQ ID NO: 66329 - DNA, 70 bp, Artificial Sequence
  Synthetic
gccaagcatttaggtgacactatagaggcagatattcccaagatcgtttcagagctatgctggaaacagc

SEQ ID NO: 66330 - DNA, 70 bp, Artificial Sequence
  Synthetic
gccaagcatttaggtgacactatagcatcatctccgagccatcaggtttcagagctatgctggaaacagc

SEQ ID NO: 66331 - DNA, 70 bp, Artificial Sequence
  Synthetic
gccaagcatttaggtgacactatagctctgatggctcggagatgagtttcagagctatgctggaaacagc

SEQ ID NO: 66332 - DNA, 70 bp, Artificial Sequence
  Synthetic
gccaagcatttaggtgacactatagccagggccccagcacggggcgtttcagagctatgctggaaacagc

SEQ ID NO: 66333 - DNA, 70 bp, Artificial Sequence
  Synthetic
gccaagcatttaggtgacactatagtgcaggtaaaaacctagcccgtttcagagctatgctggaaacagc

SEQ ID NO: 66334 - DNA, 70 bp, Artificial Sequence
  Synthetic
gccaagcatttaggtgacactataggcagccatcttgccactaaagtttcagagctatgctggaaacagc

SEQ ID NO: 66335 - DNA, 70 bp, Artificial Sequence
  Synthetic
gccaagcatttaggtgacactatagtatttcttagggaatcagtggtttcagagctatgctggaaacagc

SEQ ID NO: 66336 - DNA, 70 bp, Artificial Sequence
  Synthetic
gccaagcatttaggtgacactatagtccagcagacagctcttcaagtttcagagctatgctggaaacagc

SEQ ID NO: 66337 - DNA, 70 bp, Artificial Sequence
  Synthetic
gccaagcatttaggtgacactatagcttccatggcaggggctacggtttcagagctatgctggaaacagc

SEQ ID NO: 66338 - DNA, 70 bp, Artificial Sequence
  Synthetic
gccaagcatttaggtgacactatagctacctgcgacgcttcttcagtttcagagctatgctggaaacagc

SEQ ID NO: 66339 - DNA, 70 bp, Artificial Sequence
  Synthetic
gccaagcatttaggtgacactatagaggctttttaaacaactctcgtttcagagctatgctggaaacagc

SEQ ID NO: 66340 - DNA, 70 bp, Artificial Sequence
  Synthetic
gccaagcatttaggtgacactatagatcccagatggtgatcacacgtttcagagctatgctggaaacagc

SEQ ID NO: 66341 - DNA, 70 bp, Artificial Sequence
  Synthetic
gccaagcatttaggtgacactatagcaggatgccggggctaggaggtttcagagctatgctggaaacagc

SEQ ID NO: 66342 - DNA, 70 bp, Artificial Sequence
  Synthetic
gccaagcatttaggtgacactatagcccgctgaaaatctgttagggtttcagagctatgctggaaacagc

SEQ ID NO: 66343 - DNA, 70 bp, Artificial Sequence
  Synthetic
gccaagcatttaggtgacactatagaactgccctctcaaattacagtttcagagctatgctggaaacagc

SEQ ID NO: 66344 - DNA, 70 bp, Artificial Sequence
  Synthetic
gccaagcatttaggtgacactatagccgcagcctcccaaagtgttgtttcagagctatgctggaaacagc

SEQ ID NO: 66345 - DNA, 70 bp, Artificial Sequence
  Synthetic
gccaagcatttaggtgacactatagcttctttgaggccaagaagcgtttcagagctatgctggaaacagc

SEQ ID NO: 66346 - DNA, 70 bp, Artificial Sequence
  Synthetic
gccaagcatttaggtgacactatagagagtctgtttgaagataaggtttcagagctatgctggaaacagc

SEQ ID NO: 66347 - DNA, 70 bp, Artificial Sequence
  Synthetic
gccaagcatttaggtgacactatagagtccagactaagcaaaagtgtttcagagctatgctggaaacagc

SEQ ID NO: 66348 - DNA, 70 bp, Artificial Sequence
  Synthetic
gccaagcatttaggtgacactataggtcaccttagcttagcatctgtttcagagctatgctggaaacagc

SEQ ID NO: 66349 - DNA, 70 bp, Artificial Sequence
  Synthetic
gccaagcatttaggtgacactatagagaaccaccacaactcgtgtgtttcagagctatgctggaaacagc

SEQ ID NO: 66350 - DNA, 70 bp, Artificial Sequence
  Synthetic
gccaagcatttaggtgacactatagtgtcccagcagtccttcagcgtttcagagctatgctggaaacagc

SEQ ID NO: 66351 - DNA, 70 bp, Artificial Sequence
  Synthetic
gccaagcatttaggtgacactatagggacagctacacaagcttctgtttcagagctatgctggaaacagc

SEQ ID NO: 66352 - DNA, 70 bp, Artificial Sequence
  Synthetic
gccaagcatttaggtgacactatagttcagatacgtcatccagaagtttcagagctatgctggaaacagc

SEQ ID NO: 66353 - DNA, 70 bp, Artificial Sequence
  Synthetic
gccaagcatttaggtgacactatagcaggatctggagatggaggtgtttcagagctatgctggaaacagc

SEQ ID NO: 66354 - DNA, 70 bp, Artificial Sequence
  Synthetic
gccaagcatttaggtgacactataggtccacgaggttaatctaaagtttcagagctatgctggaaacagc

SEQ ID NO: 66355 - DNA, 70 bp, Artificial Sequence
  Synthetic
gccaagcatttaggtgacactatagtggtggtcctctgcatcacagtttcagagctatgctggaaacagc

SEQ ID NO: 66356 - DNA, 70 bp, Artificial Sequence
  Synthetic
gccaagcatttaggtgacactatagggagagtcaaacagctctcggtttcagagctatgctggaaacagc

SEQ ID NO: 66357 - DNA, 70 bp, Artificial Sequence
  Synthetic
gccaagcatttaggtgacactatagccataaaactcagccatcaggtttcagagctatgctggaaacagc

SEQ ID NO: 66358 - DNA, 70 bp, Artificial Sequence
  Synthetic
gccaagcatttaggtgacactatagggtaggaacagcgtctttaagtttcagagctatgctggaaacagc

SEQ ID NO: 66359 - DNA, 70 bp, Artificial Sequence
  Synthetic
gccaagcatttaggtgacactatagatgaggctctggggctcagggtttcagagctatgctggaaacagc

SEQ ID NO: 66360 - DNA, 70 bp, Artificial Sequence
  Synthetic
gccaagcatttaggtgacactatagtcagcgagaccaagctctgagtttcagagctatgctggaaacagc

SEQ ID NO: 66361 - DNA, 70 bp, Artificial Sequence
  Synthetic
gccaagcatttaggtgacactatagggggtgcagggattagaggggtttcagagctatgctggaaacagc

SEQ ID NO: 66362 - DNA, 70 bp, Artificial Sequence
  Synthetic
gccaagcatttaggtgacactatagggacagcagacaggtcatgggtttcagagctatgctggaaacagc

SEQ ID NO: 66363 - DNA, 70 bp, Artificial Sequence
  Synthetic
gccaagcatttaggtgacactatagtcttccagtttttactgttggtttcagagctatgctggaaacagc

SEQ ID NO: 66364 - DNA, 70 bp, Artificial Sequence
  Synthetic
gccaagcatttaggtgacactatagtagcagttgttaaatagctggtttcagagctatgctggaaacagc

SEQ ID NO: 66365 - DNA, 70 bp, Artificial Sequence
  Synthetic
gccaagcatttaggtgacactatagccgtcatgaaggtaatcagagtttcagagctatgctggaaacagc

SEQ ID NO: 66366 - DNA, 70 bp, Artificial Sequence
  Synthetic
gccaagcatttaggtgacactatagtgtcaagaaacactgtttgtgtttcagagctatgctggaaacagc

SEQ ID NO: 66367 - DNA, 70 bp, Artificial Sequence
  Synthetic
gccaagcatttaggtgacactatagagtgtggaggaggagtgagcgtttcagagctatgctggaaacagc

SEQ ID NO: 66368 - DNA, 70 bp, Artificial Sequence
  Synthetic
gccaagcatttaggtgacactatagtcttctttacacagtacaccgtttcagagctatgctggaaacagc

SEQ ID NO: 66369 - DNA, 70 bp, Artificial Sequence
  Synthetic
gccaagcatttaggtgacactatagcagcatgggaatgtgtcatagtttcagagctatgctggaaacagc

SEQ ID NO: 66370 - DNA, 70 bp, Artificial Sequence
  Synthetic
gccaagcatttaggtgacactatagacccagcgcccaggctcatagtttcagagctatgctggaaacagc

SEQ ID NO: 66371 - DNA, 70 bp, Artificial Sequence
  Synthetic
gccaagcatttaggtgacactatagtgacagtcagcgaatcgagcgtttcagagctatgctggaaacagc

SEQ ID NO: 66372 - DNA, 70 bp, Artificial Sequence
  Synthetic
gccaagcatttaggtgacactataggtggtctggagttacagcgtgtttcagagctatgctggaaacagc

SEQ ID NO: 66373 - DNA, 70 bp, Artificial Sequence
  Synthetic
gccaagcatttaggtgacactatagaaaatggtagaagtactggcgtttcagagctatgctggaaacagc

SEQ ID NO: 66374 - DNA, 70 bp, Artificial Sequence
  Synthetic
gccaagcatttaggtgacactatagtaagatccaaaatcaagacggtttcagagctatgctggaaacagc

SEQ ID NO: 66375 - DNA, 70 bp, Artificial Sequence
  Synthetic
gccaagcatttaggtgacactatagtatctccgagtctagttcgtgtttcagagctatgctggaaacagc

SEQ ID NO: 66376 - DNA, 70 bp, Artificial Sequence
  Synthetic
gccaagcatttaggtgacactatagccgggaggactgttagacacgtttcagagctatgctggaaacagc

SEQ ID NO: 66377 - DNA, 70 bp, Artificial Sequence
  Synthetic
gccaagcatttaggtgacactatagatgggcgctgtgggccctgagtttcagagctatgctggaaacagc

SEQ ID NO: 66378 - DNA, 70 bp, Artificial Sequence
  Synthetic
gccaagcatttaggtgacactatagcacgggagcaagaaggattggtttcagagctatgctggaaacagc

SEQ ID NO: 66379 - DNA, 70 bp, Artificial Sequence
  Synthetic
gccaagcatttaggtgacactataggccaagctccagaagaacaggtttcagagctatgctggaaacagc

SEQ ID NO: 66380 - DNA, 70 bp, Artificial Sequence
  Synthetic
gccaagcatttaggtgacactatagcgtgtccagggggtcacgcggtttcagagctatgctggaaacagc

SEQ ID NO: 66381 - DNA, 70 bp, Artificial Sequence
  Synthetic
gccaagcatttaggtgacactataggaccccctggacacgtgacagtttcagagctatgctggaaacagc

SEQ ID NO: 66382 - DNA, 70 bp, Artificial Sequence
  Synthetic
gccaagcatttaggtgacactatagctgtggcctctcagaattgagtttcagagctatgctggaaacagc

SEQ ID NO: 66383 - DNA, 70 bp, Artificial Sequence
  Synthetic
gccaagcatttaggtgacactatagattactcaagaagaggcattgtttcagagctatgctggaaacagc

SEQ ID NO: 66384 - DNA, 70 bp, Artificial Sequence
  Synthetic
gccaagcatttaggtgacactataggcattgccagcctcatctgagtttcagagctatgctggaaacagc

SEQ ID NO: 66385 - DNA, 70 bp, Artificial Sequence
  Synthetic
gccaagcatttaggtgacactatagaatcagtgaatttctttgccgtttcagagctatgctggaaacagc

SEQ ID NO: 66386 - DNA, 70 bp, Artificial Sequence
  Synthetic
gccaagcatttaggtgacactatagcctgttcagacgctgcttcagtttcagagctatgctggaaacagc

SEQ ID NO: 66387 - DNA, 70 bp, Artificial Sequence
  Synthetic
gccaagcatttaggtgacactatagtttgacaaagcgtcatccaagtttcagagctatgctggaaacagc

SEQ ID NO: 66388 - DNA, 70 bp, Artificial Sequence
  Synthetic
gccaagcatttaggtgacactatagtggcattagggtgtgtaagcgtttcagagctatgctggaaacagc

SEQ ID NO: 66389 - DNA, 70 bp, Artificial Sequence
  Synthetic
gccaagcatttaggtgacactataggtcatgtttatcacactcctgtttcagagctatgctggaaacagc

SEQ ID NO: 66390 - DNA, 70 bp, Artificial Sequence
  Synthetic
gccaagcatttaggtgacactataggtgtgcaccgtgcgctgagtgtttcagagctatgctggaaacagc

SEQ ID NO: 66391 - DNA, 70 bp, Artificial Sequence
  Synthetic
gccaagcatttaggtgacactatagtgtctgcatgcagcctatgcgtttcagagctatgctggaaacagc

SEQ ID NO: 66392 - DNA, 70 bp, Artificial Sequence
  Synthetic
gccaagcatttaggtgacactatagggggagggggagtgctcacagtttcagagctatgctggaaacagc

SEQ ID NO: 66393 - DNA, 70 bp, Artificial Sequence
  Synthetic
gccaagcatttaggtgacactatagggaaagtgcgaattagaccagtttcagagctatgctggaaacagc

SEQ ID NO: 66394 - DNA, 70 bp, Artificial Sequence
  Synthetic
gccaagcatttaggtgacactatagctagagactcgagttactgtgtttcagagctatgctggaaacagc

SEQ ID NO: 66395 - DNA, 70 bp, Artificial Sequence
  Synthetic
gccaagcatttaggtgacactatagtggagggtcaggagctgcccgtttcagagctatgctggaaacagc

SEQ ID NO: 66396 - DNA, 70 bp, Artificial Sequence
  Synthetic
gccaagcatttaggtgacactatagacaggactttagagactatagtttcagagctatgctggaaacagc

SEQ ID NO: 66397 - DNA, 70 bp, Artificial Sequence
  Synthetic
gccaagcatttaggtgacactatagtctggagaaactcaaagatagtttcagagctatgctggaaacagc

SEQ ID NO: 66398 - DNA, 70 bp, Artificial Sequence
  Synthetic
gccaagcatttaggtgacactatagagctgcacaactacatggaggtttcagagctatgctggaaacagc

SEQ ID NO: 66399 - DNA, 70 bp, Artificial Sequence
  Synthetic
gccaagcatttaggtgacactatagttctgcgcatgtaattgtgcgtttcagagctatgctggaaacagc

SEQ ID NO: 66400 - DNA, 70 bp, Artificial Sequence
  Synthetic
gccaagcatttaggtgacactatagccgcgatcacttctcgaagtgtttcagagctatgctggaaacagc

SEQ ID NO: 66401 - DNA, 70 bp, Artificial Sequence
  Synthetic
gccaagcatttaggtgacactatagtcatcttcaggaaaactctggtttcagagctatgctggaaacagc

SEQ ID NO: 66402 - DNA, 70 bp, Artificial Sequence
  Synthetic
gccaagcatttaggtgacactataggaacggcagctgaaacacaagtttcagagctatgctggaaacagc

SEQ ID NO: 66403 - DNA, 70 bp, Artificial Sequence
  Synthetic
gccaagcatttaggtgacactatagcaaccgacgttggagtttgggtttcagagctatgctggaaacagc

SEQ ID NO: 66404 - DNA, 70 bp, Artificial Sequence
  Synthetic
gccaagcatttaggtgacactatagaggagttcatgcaagttcgagtttcagagctatgctggaaacagc

SEQ ID NO: 66405 - DNA, 70 bp, Artificial Sequence
  Synthetic
gccaagcatttaggtgacactatagatcttgggagagtcatttaagtttcagagctatgctggaaacagc

SEQ ID NO: 66406 - DNA, 70 bp, Artificial Sequence
  Synthetic
gccaagcatttaggtgacactataggcaagcttgagagctgctaagtttcagagctatgctggaaacagc

SEQ ID NO: 66407 - DNA, 70 bp, Artificial Sequence
  Synthetic
gccaagcatttaggtgacactatagccgaccctccccacaccctagtttcagagctatgctggaaacagc

SEQ ID NO: 66408 - DNA, 70 bp, Artificial Sequence
  Synthetic
gccaagcatttaggtgacactatagtactcaggagatgttactgcgtttcagagctatgctggaaacagc

SEQ ID NO: 66409 - DNA, 70 bp, Artificial Sequence
  Synthetic
gccaagcatttaggtgacactataggcattttgcatcatcttgacgtttcagagctatgctggaaacagc

SEQ ID NO: 66410 - DNA, 70 bp, Artificial Sequence
  Synthetic
gccaagcatttaggtgacactatagccggagtccagcggggtcaggtttcagagctatgctggaaacagc

SEQ ID NO: 66411 - DNA, 70 bp, Artificial Sequence
  Synthetic
gccaagcatttaggtgacactatagcgttgtcaatgtgcactcctgtttcagagctatgctggaaacagc

SEQ ID NO: 66412 - DNA, 70 bp, Artificial Sequence
  Synthetic
gccaagcatttaggtgacactataggcagcaacaagacaagtctcgtttcagagctatgctggaaacagc

SEQ ID NO: 66413 - DNA, 70 bp, Artificial Sequence
  Synthetic
gccaagcatttaggtgacactataggaaatcccagctactcaggagtttcagagctatgctggaaacagc

SEQ ID NO: 66414 - DNA, 70 bp, Artificial Sequence
  Synthetic
gccaagcatttaggtgacactatagcaacatacgaactccaacttgtttcagagctatgctggaaacagc

SEQ ID NO: 66415 - DNA, 70 bp, Artificial Sequence
  Synthetic
gccaagcatttaggtgacactatagtggaacatgacttctgctaagtttcagagctatgctggaaacagc

SEQ ID NO: 66416 - DNA, 70 bp, Artificial Sequence
  Synthetic
gccaagcatttaggtgacactataggagagcatcgctatgatctagtttcagagctatgctggaaacagc

SEQ ID NO: 66417 - DNA, 70 bp, Artificial Sequence
  Synthetic
gccaagcatttaggtgacactatagcctgccggtccagctgtagcgtttcagagctatgctggaaacagc

SEQ ID NO: 66418 - DNA, 70 bp, Artificial Sequence
  Synthetic
gccaagcatttaggtgacactatagaaaaactgatggtttacaccgtttcagagctatgctggaaacagc

SEQ ID NO: 66419 - DNA, 70 bp, Artificial Sequence
  Synthetic
gccaagcatttaggtgacactatagggctgccagggggatgggcagtttcagagctatgctggaaacagc

SEQ ID NO: 66420 - DNA, 70 bp, Artificial Sequence
  Synthetic
gccaagcatttaggtgacactatagcggggccggaggtcacagtggtttcagagctatgctggaaacagc

SEQ ID NO: 66421 - DNA, 70 bp, Artificial Sequence
  Synthetic
gccaagcatttaggtgacactatagacctaccttgaaggaagagagtttcagagctatgctggaaacagc

SEQ ID NO: 66422 - DNA, 70 bp, Artificial Sequence
  Synthetic
gccaagcatttaggtgacactatagctggtggtggagtcacagaagtttcagagctatgctggaaacagc

SEQ ID NO: 66423 - DNA, 70 bp, Artificial Sequence
  Synthetic
gccaagcatttaggtgacactatagattggccagaactgtgtcatgtttcagagctatgctggaaacagc

SEQ ID NO: 66424 - DNA, 70 bp, Artificial Sequence
  Synthetic
gccaagcatttaggtgacactatagacttatagttctggaattgggtttcagagctatgctggaaacagc

SEQ ID NO: 66425 - DNA, 70 bp, Artificial Sequence
  Synthetic
gccaagcatttaggtgacactataggaggagcggagcgggtcactgtttcagagctatgctggaaacagc

SEQ ID NO: 66426 - DNA, 70 bp, Artificial Sequence
  Synthetic
gccaagcatttaggtgacactatagctggtgttttgctgtgtcaggtttcagagctatgctggaaacagc

SEQ ID NO: 66427 - DNA, 70 bp, Artificial Sequence
  Synthetic
gccaagcatttaggtgacactatagtctgagcagtcactcattccgtttcagagctatgctggaaacagc

SEQ ID NO: 66428 - DNA, 70 bp, Artificial Sequence
  Synthetic
gccaagcatttaggtgacactatagccacggccgtgtcgctcactgtttcagagctatgctggaaacagc

SEQ ID NO: 66429 - DNA, 70 bp, Artificial Sequence
  Synthetic
gccaagcatttaggtgacactatagtacttccaccagcacttggcgtttcagagctatgctggaaacagc

SEQ ID NO: 66430 - DNA, 70 bp, Artificial Sequence
  Synthetic
gccaagcatttaggtgacactatagctatcaccagtatctgactggtttcagagctatgctggaaacagc

SEQ ID NO: 66431 - DNA, 70 bp, Artificial Sequence
  Synthetic
gccaagcatttaggtgacactatagtaagatctcaaagaagcacagtttcagagctatgctggaaacagc

SEQ ID NO: 66432 - DNA, 70 bp, Artificial Sequence
  Synthetic
gccaagcatttaggtgacactatagtgcagcacctgaaacctagagtttcagagctatgctggaaacagc

SEQ ID NO: 66433 - DNA, 70 bp, Artificial Sequence
  Synthetic
gccaagcatttaggtgacactatagtacgagatgtttgagtgaaggtttcagagctatgctggaaacagc

SEQ ID NO: 66434 - DNA, 70 bp, Artificial Sequence
  Synthetic
gccaagcatttaggtgacactatagcttcagtctattttcttggcgtttcagagctatgctggaaacagc

SEQ ID NO: 66435 - DNA, 70 bp, Artificial Sequence
  Synthetic
gccaagcatttaggtgacactatagcagccaagaaaatagactgagtttcagagctatgctggaaacagc

SEQ ID NO: 66436 - DNA, 70 bp, Artificial Sequence
  Synthetic
gccaagcatttaggtgacactatagcataggaggcatcgttttttgtttcagagctatgctggaaacagc

SEQ ID NO: 66437 - DNA, 70 bp, Artificial Sequence
  Synthetic
gccaagcatttaggtgacactatagaaagcattcaagatagtgtcgtttcagagctatgctggaaacagc

SEQ ID NO: 66438 - DNA, 70 bp, Artificial Sequence
  Synthetic
gccaagcatttaggtgacactatagtcagctgaactctcctacacgtttcagagctatgctggaaacagc

SEQ ID NO: 66439 - DNA, 70 bp, Artificial Sequence
  Synthetic
gccaagcatttaggtgacactatagaagtttctgcttatctgcttgtttcagagctatgctggaaacagc

SEQ ID NO: 66440 - DNA, 70 bp, Artificial Sequence
  Synthetic
gccaagcatttaggtgacactatagactgtgctggacacaggacagtttcagagctatgctggaaacagc

SEQ ID NO: 66441 - DNA, 70 bp, Artificial Sequence
  Synthetic
gccaagcatttaggtgacactataggttgttgggagtttagaccggtttcagagctatgctggaaacagc

SEQ ID NO: 66442 - DNA, 70 bp, Artificial Sequence
  Synthetic
gccaagcatttaggtgacactataggaggagacatgagaaggatggtttcagagctatgctggaaacagc

SEQ ID NO: 66443 - DNA, 70 bp, Artificial Sequence
  Synthetic
gccaagcatttaggtgacactatagtcttggtggtctcctttttagtttcagagctatgctggaaacagc

SEQ ID NO: 66444 - DNA, 70 bp, Artificial Sequence
  Synthetic
gccaagcatttaggtgacactatagaggatcctcgctacactttggtttcagagctatgctggaaacagc

SEQ ID NO: 66445 - DNA, 70 bp, Artificial Sequence
  Synthetic
gccaagcatttaggtgacactatagctagagtccatagtttacgggtttcagagctatgctggaaacagc

SEQ ID NO: 66446 - DNA, 70 bp, Artificial Sequence
  Synthetic
gccaagcatttaggtgacactataggaaaaggaagaggttactgtgtttcagagctatgctggaaacagc

SEQ ID NO: 66447 - DNA, 70 bp, Artificial Sequence
  Synthetic
gccaagcatttaggtgacactatagggtctcaagagaaatccgtggtttcagagctatgctggaaacagc

SEQ ID NO: 66448 - DNA, 70 bp, Artificial Sequence
  Synthetic
gccaagcatttaggtgacactatagtatactctctccctcgctaggtttcagagctatgctggaaacagc

SEQ ID NO: 66449 - DNA, 70 bp, Artificial Sequence
  Synthetic
gccaagcatttaggtgacactatagtgggctctgtggctgctagcgtttcagagctatgctggaaacagc

SEQ ID NO: 66450 - DNA, 70 bp, Artificial Sequence
  Synthetic
gccaagcatttaggtgacactatagaaggaaatgttggaagtgaggtttcagagctatgctggaaacagc

SEQ ID NO: 66451 - DNA, 70 bp, Artificial Sequence
  Synthetic
gccaagcatttaggtgacactatagtggggtctttggcagctcacgtttcagagctatgctggaaacagc

SEQ ID NO: 66452 - DNA, 70 bp, Artificial Sequence
  Synthetic
gccaagcatttaggtgacactatagcaatccgggccgctcctgatgtttcagagctatgctggaaacagc

SEQ ID NO: 66453 - DNA, 70 bp, Artificial Sequence
  Synthetic
gccaagcatttaggtgacactatagcagtgaggacagtcataccggtttcagagctatgctggaaacagc

SEQ ID NO: 66454 - DNA, 70 bp, Artificial Sequence
  Synthetic
gccaagcatttaggtgacactatagttagcacactgtcccattctgtttcagagctatgctggaaacagc

SEQ ID NO: 66455 - DNA, 70 bp, Artificial Sequence
  Synthetic
gccaagcatttaggtgacactatagcaagggtgctggacatgggtgtttcagagctatgctggaaacagc

SEQ ID NO: 66456 - DNA, 70 bp, Artificial Sequence
  Synthetic
gccaagcatttaggtgacactatagggagaagagcgctgtcatttgtttcagagctatgctggaaacagc

SEQ ID NO: 66457 - DNA, 70 bp, Artificial Sequence
  Synthetic
gccaagcatttaggtgacactatagctccgcttattcttcaggaagtttcagagctatgctggaaacagc

SEQ ID NO: 66458 - DNA, 70 bp, Artificial Sequence
  Synthetic
gccaagcatttaggtgacactataggagaaggaaagaagactgaggtttcagagctatgctggaaacagc

SEQ ID NO: 66459 - DNA, 70 bp, Artificial Sequence
  Synthetic
gccaagcatttaggtgacactatagcatccgggccaagtacaagggtttcagagctatgctggaaacagc

SEQ ID NO: 66460 - DNA, 70 bp, Artificial Sequence
  Synthetic
gccaagcatttaggtgacactatagtactatttctggttgttggagtttcagagctatgctggaaacagc

SEQ ID NO: 66461 - DNA, 70 bp, Artificial Sequence
  Synthetic
gccaagcatttaggtgacactatagtcggaaactgcgcagtgaacgtttcagagctatgctggaaacagc

SEQ ID NO: 66462 - DNA, 70 bp, Artificial Sequence
  Synthetic
gccaagcatttaggtgacactataggaagcagtaactacgctctcgtttcagagctatgctggaaacagc

SEQ ID NO: 66463 - DNA, 70 bp, Artificial Sequence
  Synthetic
gccaagcatttaggtgacactatagcagtggagtccgggctagaggtttcagagctatgctggaaacagc

SEQ ID NO: 66464 - DNA, 70 bp, Artificial Sequence
  Synthetic
gccaagcatttaggtgacactatagcagctctgatgatgaattctgtttcagagctatgctggaaacagc

SEQ ID NO: 66465 - DNA, 70 bp, Artificial Sequence
  Synthetic
gccaagcatttaggtgacactatagccatactgttcaggaatccagtttcagagctatgctggaaacagc

SEQ ID NO: 66466 - DNA, 70 bp, Artificial Sequence
  Synthetic
gccaagcatttaggtgacactatagacaagatcatccactggcccgtttcagagctatgctggaaacagc

SEQ ID NO: 66467 - DNA, 70 bp, Artificial Sequence
  Synthetic
gccaagcatttaggtgacactatagcccggaagtggcatctaatcgtttcagagctatgctggaaacagc

SEQ ID NO: 66468 - DNA, 70 bp, Artificial Sequence
  Synthetic
gccaagcatttaggtgacactatagtcctctctaggagtttaatcgtttcagagctatgctggaaacagc

SEQ ID NO: 66469 - DNA, 70 bp, Artificial Sequence
  Synthetic
gccaagcatttaggtgacactataggcgtttcacacaggtgtttggtttcagagctatgctggaaacagc

SEQ ID NO: 66470 - DNA, 70 bp, Artificial Sequence
  Synthetic
gccaagcatttaggtgacactatagtcaacgcgtcttcccgccaggtttcagagctatgctggaaacagc

SEQ ID NO: 66471 - DNA, 70 bp, Artificial Sequence
  Synthetic
gccaagcatttaggtgacactatagcctgacgggcgagaagcctcgtttcagagctatgctggaaacagc

SEQ ID NO: 66472 - DNA, 70 bp, Artificial Sequence
  Synthetic
gccaagcatttaggtgacactatagatgaaataaagttcacccccgtttcagagctatgctggaaacagc

SEQ ID NO: 66473 - DNA, 70 bp, Artificial Sequence
  Synthetic
gccaagcatttaggtgacactataggcgaggaagaggaggattaggtttcagagctatgctggaaacagc

SEQ ID NO: 66474 - DNA, 70 bp, Artificial Sequence
  Synthetic
gccaagcatttaggtgacactataggcggggcgctgcacttaggtgtttcagagctatgctggaaacagc

SEQ ID NO: 66475 - DNA, 70 bp, Artificial Sequence
  Synthetic
gccaagcatttaggtgacactatagtcagccaagtagaacgtgaggtttcagagctatgctggaaacagc

SEQ ID NO: 66476 - DNA, 70 bp, Artificial Sequence
  Synthetic
gccaagcatttaggtgacactatagggaccacagctgatatttaagtttcagagctatgctggaaacagc

SEQ ID NO: 66477 - DNA, 70 bp, Artificial Sequence
  Synthetic
gccaagcatttaggtgacactatagagatatggctatacccgcacgtttcagagctatgctggaaacagc

SEQ ID NO: 66478 - DNA, 70 bp, Artificial Sequence
  Synthetic
gccaagcatttaggtgacactatagcgagctgggagaactgtaacgtttcagagctatgctggaaacagc

SEQ ID NO: 66479 - DNA, 70 bp, Artificial Sequence
  Synthetic
gccaagcatttaggtgacactatagaagcttgctttagcagttccgtttcagagctatgctggaaacagc

SEQ ID NO: 66480 - DNA, 70 bp, Artificial Sequence
  Synthetic
gccaagcatttaggtgacactatagagaggggaacttctgaaacagtttcagagctatgctggaaacagc

SEQ ID NO: 66481 - DNA, 70 bp, Artificial Sequence
  Synthetic
gccaagcatttaggtgacactataggtctcccctctcttcagaccgtttcagagctatgctggaaacagc

SEQ ID NO: 66482 - DNA, 70 bp, Artificial Sequence
  Synthetic
gccaagcatttaggtgacactataggaagaagaactggaaagcacgtttcagagctatgctggaaacagc

SEQ ID NO: 66483 - DNA, 70 bp, Artificial Sequence
  Synthetic
gccaagcatttaggtgacactatagatggctgcttctctgaccttgtttcagagctatgctggaaacagc

SEQ ID NO: 66484 - DNA, 70 bp, Artificial Sequence
  Synthetic
gccaagcatttaggtgacactatagctccaacggtgggtcagcgcgtttcagagctatgctggaaacagc

SEQ ID NO: 66485 - DNA, 70 bp, Artificial Sequence
  Synthetic
gccaagcatttaggtgacactataggtcaggactgtggtggtgatgtttcagagctatgctggaaacagc

SEQ ID NO: 66486 - DNA, 70 bp, Artificial Sequence
  Synthetic
gccaagcatttaggtgacactataggtgaggctagttgacccgacgtttcagagctatgctggaaacagc

SEQ ID NO: 66487 - DNA, 70 bp, Artificial Sequence
  Synthetic
gccaagcatttaggtgacactatagctgagaagggcgactcagcagtttcagagctatgctggaaacagc

SEQ ID NO: 66488 - DNA, 70 bp, Artificial Sequence
  Synthetic
gccaagcatttaggtgacactataggaaataaggagcctctagcagtttcagagctatgctggaaacagc

SEQ ID NO: 66489 - DNA, 70 bp, Artificial Sequence
  Synthetic
gccaagcatttaggtgacactatagcgaggtgacttcagcttatggtttcagagctatgctggaaacagc

SEQ ID NO: 66490 - DNA, 70 bp, Artificial Sequence
  Synthetic
gccaagcatttaggtgacactatagacaatttcttcatatggagggtttcagagctatgctggaaacagc

SEQ ID NO: 66491 - DNA, 70 bp, Artificial Sequence
  Synthetic
gccaagcatttaggtgacactatagaggagcggcggcagatgaaggtttcagagctatgctggaaacagc

SEQ ID NO: 66492 - DNA, 70 bp, Artificial Sequence
  Synthetic
gccaagcatttaggtgacactatagagagttaatcttggtctatcgtttcagagctatgctggaaacagc

SEQ ID NO: 66493 - DNA, 70 bp, Artificial Sequence
  Synthetic
gccaagcatttaggtgacactataggcccctaccacctgagtagagtttcagagctatgctggaaacagc

SEQ ID NO: 66494 - DNA, 70 bp, Artificial Sequence
  Synthetic
gccaagcatttaggtgacactatagtggcacaaagatgattctctgtttcagagctatgctggaaacagc

SEQ ID NO: 66495 - DNA, 70 bp, Artificial Sequence
  Synthetic
gccaagcatttaggtgacactatagaaagggtttgggttcccagcgtttcagagctatgctggaaacagc

SEQ ID NO: 66496 - DNA, 70 bp, Artificial Sequence
  Synthetic
gccaagcatttaggtgacactataggtctcacgcttgcaagtcctgtttcagagctatgctggaaacagc

SEQ ID NO: 66497 - DNA, 70 bp, Artificial Sequence
  Synthetic
gccaagcatttaggtgacactatagaggaaggcagggcctactgcgtttcagagctatgctggaaacagc

SEQ ID NO: 66498 - DNA, 70 bp, Artificial Sequence
  Synthetic
gccaagcatttaggtgacactatagtgtaggcagagattagacgagtttcagagctatgctggaaacagc

SEQ ID NO: 66499 - DNA, 70 bp, Artificial Sequence
  Synthetic
gccaagcatttaggtgacactatagtcaccttggctgctttctccgtttcagagctatgctggaaacagc

SEQ ID NO: 66500 - DNA, 70 bp, Artificial Sequence
  Synthetic
gccaagcatttaggtgacactatagtttacttgaggtgctcacctgtttcagagctatgctggaaacagc

SEQ ID NO: 66501 - DNA, 70 bp, Artificial Sequence
  Synthetic
gccaagcatttaggtgacactatagctttgagaggcagaggtagggtttcagagctatgctggaaacagc

SEQ ID NO: 66502 - DNA, 70 bp, Artificial Sequence
  Synthetic
gccaagcatttaggtgacactatagagtactttgagaggcagagggtttcagagctatgctggaaacagc

SEQ ID NO: 66503 - DNA, 70 bp, Artificial Sequence
  Synthetic
gccaagcatttaggtgacactatagtattgtgtatctacaggtgcgtttcagagctatgctggaaacagc

SEQ ID NO: 66504 - DNA, 70 bp, Artificial Sequence
  Synthetic
gccaagcatttaggtgacactatagtttcctgaagagtggtcagtgtttcagagctatgctggaaacagc

SEQ ID NO: 66505 - DNA, 70 bp, Artificial Sequence
  Synthetic
gccaagcatttaggtgacactatagggtctagaacccggctctgagtttcagagctatgctggaaacagc

SEQ ID NO: 66506 - DNA, 70 bp, Artificial Sequence
  Synthetic
gccaagcatttaggtgacactatagattactgtcttgcagtgagtgtttcagagctatgctggaaacagc

SEQ ID NO: 66507 - DNA, 70 bp, Artificial Sequence
  Synthetic
gccaagcatttaggtgacactatagtccctgggctcacaccagtggtttcagagctatgctggaaacagc

SEQ ID NO: 66508 - DNA, 70 bp, Artificial Sequence
  Synthetic
gccaagcatttaggtgacactatagggccaccgagcagccatcacgtttcagagctatgctggaaacagc

SEQ ID NO: 66509 - DNA, 70 bp, Artificial Sequence
  Synthetic
gccaagcatttaggtgacactatagggtcatttcttcacaagctcgtttcagagctatgctggaaacagc

SEQ ID NO: 66510 - DNA, 70 bp, Artificial Sequence
  Synthetic
gccaagcatttaggtgacactataggtaacctgggctctgtgattgtttcagagctatgctggaaacagc

SEQ ID NO: 66511 - DNA, 70 bp, Artificial Sequence
  Synthetic
gccaagcatttaggtgacactatagctcagtacaaaaggagacacgtttcagagctatgctggaaacagc

SEQ ID NO: 66512 - DNA, 70 bp, Artificial Sequence
  Synthetic
gccaagcatttaggtgacactatagaatttccaacgtgttgtggagtttcagagctatgctggaaacagc

SEQ ID NO: 66513 - DNA, 70 bp, Artificial Sequence
  Synthetic
gccaagcatttaggtgacactatagcatgtcaagactgactgagcgtttcagagctatgctggaaacagc

SEQ ID NO: 66514 - DNA, 70 bp, Artificial Sequence
  Synthetic
gccaagcatttaggtgacactataggggtgctagtcatcaaagtcgtttcagagctatgctggaaacagc

SEQ ID NO: 66515 - DNA, 70 bp, Artificial Sequence
  Synthetic
gccaagcatttaggtgacactatagtagaggcaccaacctcagtcgtttcagagctatgctggaaacagc

SEQ ID NO: 66516 - DNA, 70 bp, Artificial Sequence
  Synthetic
gccaagcatttaggtgacactatagaaggagcacttatcctagaagtttcagagctatgctggaaacagc

SEQ ID NO: 66517 - DNA, 70 bp, Artificial Sequence
  Synthetic
gccaagcatttaggtgacactatagagccctatgaacttccttatgtttcagagctatgctggaaacagc

SEQ ID NO: 66518 - DNA, 70 bp, Artificial Sequence
  Synthetic
gccaagcatttaggtgacactatagcttgtgcagttcacttcacagtttcagagctatgctggaaacagc

SEQ ID NO: 66519 - DNA, 70 bp, Artificial Sequence
  Synthetic
gccaagcatttaggtgacactatagcaacagtctaccctttgagtgtttcagagctatgctggaaacagc

SEQ ID NO: 66520 - DNA, 70 bp, Artificial Sequence
  Synthetic
gccaagcatttaggtgacactatagatttgcaggggtggggggcagtttcagagctatgctggaaacagc

SEQ ID NO: 66521 - DNA, 70 bp, Artificial Sequence
  Synthetic
gccaagcatttaggtgacactatagggagacgtccaggctctcacgtttcagagctatgctggaaacagc

SEQ ID NO: 66522 - DNA, 70 bp, Artificial Sequence
  Synthetic
gccaagcatttaggtgacactatagggcagaaaaaatcctgattcgtttcagagctatgctggaaacagc

SEQ ID NO: 66523 - DNA, 70 bp, Artificial Sequence
  Synthetic
gccaagcatttaggtgacactatagggtgagctggtattatgaaggtttcagagctatgctggaaacagc

SEQ ID NO: 66524 - DNA, 70 bp, Artificial Sequence
  Synthetic
gccaagcatttaggtgacactataggcgggcgcgggcagcgagtggtttcagagctatgctggaaacagc

SEQ ID NO: 66525 - DNA, 70 bp, Artificial Sequence
  Synthetic
gccaagcatttaggtgacactatagtcaggatttggatcaatagagtttcagagctatgctggaaacagc

SEQ ID NO: 66526 - DNA, 70 bp, Artificial Sequence
  Synthetic
gccaagcatttaggtgacactatagtaagtccccgtgcggctcacgtttcagagctatgctggaaacagc

SEQ ID NO: 66527 - DNA, 70 bp, Artificial Sequence
  Synthetic
gccaagcatttaggtgacactatagccttgctggttttctcagaggtttcagagctatgctggaaacagc

SEQ ID NO: 66528 - DNA, 70 bp, Artificial Sequence
  Synthetic
gccaagcatttaggtgacactatagtcatccatgctcatctcattgtttcagagctatgctggaaacagc

SEQ ID NO: 66529 - DNA, 70 bp, Artificial Sequence
  Synthetic
gccaagcatttaggtgacactatagttccatgatgtgggaaggtggtttcagagctatgctggaaacagc

SEQ ID NO: 66530 - DNA, 70 bp, Artificial Sequence
  Synthetic
gccaagcatttaggtgacactatagtcacattggtgggctgctttgtttcagagctatgctggaaacagc

SEQ ID NO: 66531 - DNA, 70 bp, Artificial Sequence
  Synthetic
gccaagcatttaggtgacactatagaaatcttcagtaggttgatggtttcagagctatgctggaaacagc

SEQ ID NO: 66532 - DNA, 70 bp, Artificial Sequence
  Synthetic
gccaagcatttaggtgacactatagggcatctcttggcaccctaggtttcagagctatgctggaaacagc

SEQ ID NO: 66533 - DNA, 70 bp, Artificial Sequence
  Synthetic
gccaagcatttaggtgacactatagaaatggctgcaatgcagaatgtttcagagctatgctggaaacagc

SEQ ID NO: 66534 - DNA, 70 bp, Artificial Sequence
  Synthetic
gccaagcatttaggtgacactatagtcctgaattttgtcccgagagtttcagagctatgctggaaacagc

SEQ ID NO: 66535 - DNA, 70 bp, Artificial Sequence
  Synthetic
gccaagcatttaggtgacactataggccctcagagtcacacctccgtttcagagctatgctggaaacagc

SEQ ID NO: 66536 - DNA, 70 bp, Artificial Sequence
  Synthetic
gccaagcatttaggtgacactatagccacctcgggactgtgttctgtttcagagctatgctggaaacagc

SEQ ID NO: 66537 - DNA, 70 bp, Artificial Sequence
  Synthetic
gccaagcatttaggtgacactatagcaacagtgtggaagctttaggtttcagagctatgctggaaacagc

SEQ ID NO: 66538 - DNA, 70 bp, Artificial Sequence
  Synthetic
gccaagcatttaggtgacactataggcgtgagcagtgatgagatcgtttcagagctatgctggaaacagc

SEQ ID NO: 66539 - DNA, 70 bp, Artificial Sequence
  Synthetic
gccaagcatttaggtgacactatagggcggcctcctcaccagccagtttcagagctatgctggaaacagc

SEQ ID NO: 66540 - DNA, 70 bp, Artificial Sequence
  Synthetic
gccaagcatttaggtgacactatagcacttgcccccaaagtcacagtttcagagctatgctggaaacagc

SEQ ID NO: 66541 - DNA, 70 bp, Artificial Sequence
  Synthetic
gccaagcatttaggtgacactatagtcgccaccaggcatttgtcagtttcagagctatgctggaaacagc

SEQ ID NO: 66542 - DNA, 70 bp, Artificial Sequence
  Synthetic
gccaagcatttaggtgacactatagaggcgaggccaagagtgctggtttcagagctatgctggaaacagc

SEQ ID NO: 66543 - DNA, 70 bp, Artificial Sequence
  Synthetic
gccaagcatttaggtgacactatagtggagagcattctctcaggggtttcagagctatgctggaaacagc

SEQ ID NO: 66544 - DNA, 70 bp, Artificial Sequence
  Synthetic
gccaagcatttaggtgacactatagccgtttgtaagcaatcaagagtttcagagctatgctggaaacagc

SEQ ID NO: 66545 - DNA, 70 bp, Artificial Sequence
  Synthetic
gccaagcatttaggtgacactatagctctcccacatgaatcagccgtttcagagctatgctggaaacagc

SEQ ID NO: 66546 - DNA, 70 bp, Artificial Sequence
  Synthetic
gccaagcatttaggtgacactataggcacaatactatggcatacagtttcagagctatgctggaaacagc

SEQ ID NO: 66547 - DNA, 70 bp, Artificial Sequence
  Synthetic
gccaagcatttaggtgacactatagccaccttacagtccctaaaggtttcagagctatgctggaaacagc

SEQ ID NO: 66548 - DNA, 70 bp, Artificial Sequence
  Synthetic
gccaagcatttaggtgacactatagacgcctctatcagggtgcgtgtttcagagctatgctggaaacagc

SEQ ID NO: 66549 - DNA, 70 bp, Artificial Sequence
  Synthetic
gccaagcatttaggtgacactatagaaagggagctcaaagagccagtttcagagctatgctggaaacagc

SEQ ID NO: 66550 - DNA, 70 bp, Artificial Sequence
  Synthetic
gccaagcatttaggtgacactatagctcttcctgctgctctgggtgtttcagagctatgctggaaacagc

SEQ ID NO: 66551 - DNA, 70 bp, Artificial Sequence
  Synthetic
gccaagcatttaggtgacactatagccagcaccagcaagcggcatgtttcagagctatgctggaaacagc

SEQ ID NO: 66552 - DNA, 70 bp, Artificial Sequence
  Synthetic
gccaagcatttaggtgacactatagcggaggcgccctcggaggtggtttcagagctatgctggaaacagc

SEQ ID NO: 66553 - DNA, 70 bp, Artificial Sequence
  Synthetic
gccaagcatttaggtgacactatagcaatcaataactaaggggtggtttcagagctatgctggaaacagc

SEQ ID NO: 66554 - DNA, 70 bp, Artificial Sequence
  Synthetic
gccaagcatttaggtgacactatagaactgcaaagtctgagaaatgtttcagagctatgctggaaacagc

SEQ ID NO: 66555 - DNA, 70 bp, Artificial Sequence
  Synthetic
gccaagcatttaggtgacactataggagtcggaacagggctaagggtttcagagctatgctggaaacagc

SEQ ID NO: 66556 - DNA, 70 bp, Artificial Sequence
  Synthetic
gccaagcatttaggtgacactatagtccgactccccaggcctcaggtttcagagctatgctggaaacagc

SEQ ID NO: 66557 - DNA, 70 bp, Artificial Sequence
  Synthetic
gccaagcatttaggtgacactataggtaaacaaagtgcccttaacgtttcagagctatgctggaaacagc

SEQ ID NO: 66558 - DNA, 70 bp, Artificial Sequence
  Synthetic
gccaagcatttaggtgacactatagaaagtgcttagaacacagccgtttcagagctatgctggaaacagc

SEQ ID NO: 66559 - DNA, 70 bp, Artificial Sequence
  Synthetic
gccaagcatttaggtgacactatagcatggcaggctctaggcctcgtttcagagctatgctggaaacagc

SEQ ID NO: 66560 - DNA, 70 bp, Artificial Sequence
  Synthetic
gccaagcatttaggtgacactatagggagttcgtattgatgtctggtttcagagctatgctggaaacagc

SEQ ID NO: 66561 - DNA, 70 bp, Artificial Sequence
  Synthetic
gccaagcatttaggtgacactatagcatccctaggtcacctcgccgtttcagagctatgctggaaacagc

SEQ ID NO: 66562 - DNA, 70 bp, Artificial Sequence
  Synthetic
gccaagcatttaggtgacactatagtgtctttcgccacagcactggtttcagagctatgctggaaacagc

SEQ ID NO: 66563 - DNA, 70 bp, Artificial Sequence
  Synthetic
gccaagcatttaggtgacactataggaggctcacccctctctgaagtttcagagctatgctggaaacagc

SEQ ID NO: 66564 - DNA, 70 bp, Artificial Sequence
  Synthetic
gccaagcatttaggtgacactatagatggggatacatttattctcgtttcagagctatgctggaaacagc

SEQ ID NO: 66565 - DNA, 70 bp, Artificial Sequence
  Synthetic
gccaagcatttaggtgacactatagaggcagctgtcagtcttcatgtttcagagctatgctggaaacagc

SEQ ID NO: 66566 - DNA, 70 bp, Artificial Sequence
  Synthetic
gccaagcatttaggtgacactatagccaagcattggctaagtgacgtttcagagctatgctggaaacagc

SEQ ID NO: 66567 - DNA, 70 bp, Artificial Sequence
  Synthetic
gccaagcatttaggtgacactatagctagcagtacaactcccagagtttcagagctatgctggaaacagc

SEQ ID NO: 66568 - DNA, 70 bp, Artificial Sequence
  Synthetic
gccaagcatttaggtgacactatagggaccaggacgacgacgacggtttcagagctatgctggaaacagc

SEQ ID NO: 66569 - DNA, 70 bp, Artificial Sequence
  Synthetic
gccaagcatttaggtgacactatagaaagggaaagaattgtaggagtttcagagctatgctggaaacagc

SEQ ID NO: 66570 - DNA, 70 bp, Artificial Sequence
  Synthetic
gccaagcatttaggtgacactatagtggtgccaatctgcttataagtttcagagctatgctggaaacagc

SEQ ID NO: 66571 - DNA, 70 bp, Artificial Sequence
  Synthetic
gccaagcatttaggtgacactatagggcccctcagggcaaagtgagtttcagagctatgctggaaacagc

SEQ ID NO: 66572 - DNA, 70 bp, Artificial Sequence
  Synthetic
gccaagcatttaggtgacactataggacagagatgctctacttccgtttcagagctatgctggaaacagc

SEQ ID NO: 66573 - DNA, 70 bp, Artificial Sequence
  Synthetic
gccaagcatttaggtgacactatagaaatttccacggtcattcccgtttcagagctatgctggaaacagc

SEQ ID NO: 66574 - DNA, 70 bp, Artificial Sequence
  Synthetic
gccaagcatttaggtgacactatagggccaagaaggcggattagggtttcagagctatgctggaaacagc

SEQ ID NO: 66575 - DNA, 70 bp, Artificial Sequence
  Synthetic
gccaagcatttaggtgacactatagttatctgaggcaacatctacgtttcagagctatgctggaaacagc

SEQ ID NO: 66576 - DNA, 70 bp, Artificial Sequence
  Synthetic
gccaagcatttaggtgacactatagactcaacagttatgaactcagtttcagagctatgctggaaacagc

SEQ ID NO: 66577 - DNA, 70 bp, Artificial Sequence
  Synthetic
gccaagcatttaggtgacactatagaccccagggctcaggagaaagtttcagagctatgctggaaacagc

SEQ ID NO: 66578 - DNA, 70 bp, Artificial Sequence
  Synthetic
gccaagcatttaggtgacactataggggttcaggaagactgactggtttcagagctatgctggaaacagc

SEQ ID NO: 66579 - DNA, 70 bp, Artificial Sequence
  Synthetic
gccaagcatttaggtgacactatagagtagaaaagacacatgatcgtttcagagctatgctggaaacagc

SEQ ID NO: 66580 - DNA, 70 bp, Artificial Sequence
  Synthetic
gccaagcatttaggtgacactatagagttttttttggaagatggcgtttcagagctatgctggaaacagc

SEQ ID NO: 66581 - DNA, 70 bp, Artificial Sequence
  Synthetic
gccaagcatttaggtgacactatagatggatgatgccaaggctctgtttcagagctatgctggaaacagc

SEQ ID NO: 66582 - DNA, 70 bp, Artificial Sequence
  Synthetic
gccaagcatttaggtgacactatagtggtgctactgctgcttgtggtttcagagctatgctggaaacagc

SEQ ID NO: 66583 - DNA, 70 bp, Artificial Sequence
  Synthetic
gccaagcatttaggtgacactatagacgggtgccagccaaaaagtgtttcagagctatgctggaaacagc

SEQ ID NO: 66584 - DNA, 70 bp, Artificial Sequence
  Synthetic
gccaagcatttaggtgacactatagccttcgaggttcacatcttcgtttcagagctatgctggaaacagc

SEQ ID NO: 66585 - DNA, 70 bp, Artificial Sequence
  Synthetic
gccaagcatttaggtgacactatagggtgttaatcatcatcactcgtttcagagctatgctggaaacagc

SEQ ID NO: 66586 - DNA, 70 bp, Artificial Sequence
  Synthetic
gccaagcatttaggtgacactatagaggctctgctcctcagaagtgtttcagagctatgctggaaacagc

SEQ ID NO: 66587 - DNA, 70 bp, Artificial Sequence
  Synthetic
gccaagcatttaggtgacactatagcctcttgagtggctcagatggtttcagagctatgctggaaacagc

SEQ ID NO: 66588 - DNA, 70 bp, Artificial Sequence
  Synthetic
gccaagcatttaggtgacactatagcttcatagttcttagggttcgtttcagagctatgctggaaacagc

SEQ ID NO: 66589 - DNA, 70 bp, Artificial Sequence
  Synthetic
gccaagcatttaggtgacactatagaaagataaagggagcacccagtttcagagctatgctggaaacagc

SEQ ID NO: 66590 - DNA, 70 bp, Artificial Sequence
  Synthetic
gccaagcatttaggtgacactatagttggccgcactgaagacttagtttcagagctatgctggaaacagc

SEQ ID NO: 66591 - DNA, 70 bp, Artificial Sequence
  Synthetic
gccaagcatttaggtgacactatagttggaagaaccgaagagctagtttcagagctatgctggaaacagc

SEQ ID NO: 66592 - DNA, 70 bp, Artificial Sequence
  Synthetic
gccaagcatttaggtgacactataggtactatgttcccagctacggtttcagagctatgctggaaacagc

SEQ ID NO: 66593 - DNA, 70 bp, Artificial Sequence
  Synthetic
gccaagcatttaggtgacactatagcacccggccgcccgactgaagtttcagagctatgctggaaacagc

SEQ ID NO: 66594 - DNA, 70 bp, Artificial Sequence
  Synthetic
gccaagcatttaggtgacactatagcgttctcctacctccttcaagtttcagagctatgctggaaacagc

SEQ ID NO: 66595 - DNA, 70 bp, Artificial Sequence
  Synthetic
gccaagcatttaggtgacactatagcgactcgaatagttgactctgtttcagagctatgctggaaacagc

SEQ ID NO: 66596 - DNA, 70 bp, Artificial Sequence
  Synthetic
gccaagcatttaggtgacactatagcgcaactgcgtccgctgctggtttcagagctatgctggaaacagc

SEQ ID NO: 66597 - DNA, 70 bp, Artificial Sequence
  Synthetic
gccaagcatttaggtgacactatagggcaggacatcatctctcaggtttcagagctatgctggaaacagc

SEQ ID NO: 66598 - DNA, 70 bp, Artificial Sequence
  Synthetic
gccaagcatttaggtgacactatagtggatgtgatgaatgtcatggtttcagagctatgctggaaacagc

SEQ ID NO: 66599 - DNA, 70 bp, Artificial Sequence
  Synthetic
gccaagcatttaggtgacactatagagaattcacacaaaagctgagtttcagagctatgctggaaacagc

SEQ ID NO: 66600 - DNA, 70 bp, Artificial Sequence
  Synthetic
gccaagcatttaggtgacactatagaccagcccctgaagaaatgagtttcagagctatgctggaaacagc

SEQ ID NO: 66601 - DNA, 70 bp, Artificial Sequence
  Synthetic
gccaagcatttaggtgacactatagtgagcaagattcacttttgtgtttcagagctatgctggaaacagc

SEQ ID NO: 66602 - DNA, 70 bp, Artificial Sequence
  Synthetic
gccaagcatttaggtgacactatagttcaaactagcctgcttagagtttcagagctatgctggaaacagc

SEQ ID NO: 66603 - DNA, 70 bp, Artificial Sequence
  Synthetic
gccaagcatttaggtgacactataggctggacctgaccaagctgtgtttcagagctatgctggaaacagc

SEQ ID NO: 66604 - DNA, 70 bp, Artificial Sequence
  Synthetic
gccaagcatttaggtgacactataggctggggctttaacagaactgtttcagagctatgctggaaacagc

SEQ ID NO: 66605 - DNA, 70 bp, Artificial Sequence
  Synthetic
gccaagcatttaggtgacactatagctgcacggggaggaagttaagtttcagagctatgctggaaacagc

SEQ ID NO: 66606 - DNA, 70 bp, Artificial Sequence
  Synthetic
gccaagcatttaggtgacactatagaaagccacctgagctcctgagtttcagagctatgctggaaacagc

SEQ ID NO: 66607 - DNA, 70 bp, Artificial Sequence
  Synthetic
gccaagcatttaggtgacactataggctgccccccaggaggcctggtttcagagctatgctggaaacagc

SEQ ID NO: 66608 - DNA, 70 bp, Artificial Sequence
  Synthetic
gccaagcatttaggtgacactataggggcccctccctccccttacgtttcagagctatgctggaaacagc

SEQ ID NO: 66609 - DNA, 70 bp, Artificial Sequence
  Synthetic
gccaagcatttaggtgacactatagcagaaccagtaccactgaccgtttcagagctatgctggaaacagc

SEQ ID NO: 66610 - DNA, 70 bp, Artificial Sequence
  Synthetic
gccaagcatttaggtgacactatagaccctaacattttctggagggtttcagagctatgctggaaacagc

SEQ ID NO: 66611 - DNA, 70 bp, Artificial Sequence
  Synthetic
gccaagcatttaggtgacactatagaggtgaagaagatgaaaaacgtttcagagctatgctggaaacagc

SEQ ID NO: 66612 - DNA, 70 bp, Artificial Sequence
  Synthetic
gccaagcatttaggtgacactatagtttggcatccaaaacattgggtttcagagctatgctggaaacagc

SEQ ID NO: 66613 - DNA, 70 bp, Artificial Sequence
  Synthetic
gccaagcatttaggtgacactatagaaagcactcataatgtttccgtttcagagctatgctggaaacagc

SEQ ID NO: 66614 - DNA, 70 bp, Artificial Sequence
  Synthetic
gccaagcatttaggtgacactataggaaggatttagatcacttgggtttcagagctatgctggaaacagc

SEQ ID NO: 66615 - DNA, 70 bp, Artificial Sequence
  Synthetic
gccaagcatttaggtgacactataggccattcatgtgtgctgcatgtttcagagctatgctggaaacagc

SEQ ID NO: 66616 - DNA, 70 bp, Artificial Sequence
  Synthetic
gccaagcatttaggtgacactataggaaaaaggacataagagaccgtttcagagctatgctggaaacagc

SEQ ID NO: 66617 - DNA, 70 bp, Artificial Sequence
  Synthetic
gccaagcatttaggtgacactatagaagaaaccagtgaagagaaagtttcagagctatgctggaaacagc

SEQ ID NO: 66618 - DNA, 70 bp, Artificial Sequence
  Synthetic
gccaagcatttaggtgacactatagccatcttctgatttgtcagagtttcagagctatgctggaaacagc

SEQ ID NO: 66619 - DNA, 70 bp, Artificial Sequence
  Synthetic
gccaagcatttaggtgacactatagtcaaaaccactgcctgtgctgtttcagagctatgctggaaacagc

SEQ ID NO: 66620 - DNA, 70 bp, Artificial Sequence
  Synthetic
gccaagcatttaggtgacactatagctggagcaagcgctcagaacgtttcagagctatgctggaaacagc

SEQ ID NO: 66621 - DNA, 70 bp, Artificial Sequence
  Synthetic
gccaagcatttaggtgacactatagtctggaactgtccttggtaggtttcagagctatgctggaaacagc

SEQ ID NO: 66622 - DNA, 70 bp, Artificial Sequence
  Synthetic
gccaagcatttaggtgacactataggggctagttcttaagacctcgtttcagagctatgctggaaacagc

SEQ ID NO: 66623 - DNA, 70 bp, Artificial Sequence
  Synthetic
gccaagcatttaggtgacactataggggcggagaggctcagccccgtttcagagctatgctggaaacagc

SEQ ID NO: 66624 - DNA, 70 bp, Artificial Sequence
  Synthetic
gccaagcatttaggtgacactatagcccgggtgtccgtagctaccgtttcagagctatgctggaaacagc

SEQ ID NO: 66625 - DNA, 70 bp, Artificial Sequence
  Synthetic
gccaagcatttaggtgacactatagccggtgcaagagtggactctgtttcagagctatgctggaaacagc

SEQ ID NO: 66626 - DNA, 70 bp, Artificial Sequence
  Synthetic
gccaagcatttaggtgacactatagcctgttgccttcatggttaagtttcagagctatgctggaaacagc

SEQ ID NO: 66627 - DNA, 70 bp, Artificial Sequence
  Synthetic
gccaagcatttaggtgacactatagcttgaagctgtcactgctgcgtttcagagctatgctggaaacagc

SEQ ID NO: 66628 - DNA, 70 bp, Artificial Sequence
  Synthetic
gccaagcatttaggtgacactatagcctccctgaggcaggtcaaggtttcagagctatgctggaaacagc

SEQ ID NO: 66629 - DNA, 70 bp, Artificial Sequence
  Synthetic
gccaagcatttaggtgacactatagccagaccctggcacctcagtgtttcagagctatgctggaaacagc

SEQ ID NO: 66630 - DNA, 70 bp, Artificial Sequence
  Synthetic
gccaagcatttaggtgacactataggtgcccaagactgactgactgtttcagagctatgctggaaacagc

SEQ ID NO: 66631 - DNA, 70 bp, Artificial Sequence
  Synthetic
gccaagcatttaggtgacactataggaaaggtccaaaatggagtagtttcagagctatgctggaaacagc

SEQ ID NO: 66632 - DNA, 70 bp, Artificial Sequence
  Synthetic
gccaagcatttaggtgacactatagtcttttaggagaaaaacagggtttcagagctatgctggaaacagc

SEQ ID NO: 66633 - DNA, 70 bp, Artificial Sequence
  Synthetic
gccaagcatttaggtgacactatagaatcatgaccagatctgaaagtttcagagctatgctggaaacagc

SEQ ID NO: 66634 - DNA, 70 bp, Artificial Sequence
  Synthetic
gccaagcatttaggtgacactatagtcaatcctgaacatctaggcgtttcagagctatgctggaaacagc

SEQ ID NO: 66635 - DNA, 70 bp, Artificial Sequence
  Synthetic
gccaagcatttaggtgacactatagtcccacatcaggaaaggtctgtttcagagctatgctggaaacagc

SEQ ID NO: 66636 - DNA, 70 bp, Artificial Sequence
  Synthetic
gccaagcatttaggtgacactatagggacgagcaactctgcgcctgtttcagagctatgctggaaacagc

SEQ ID NO: 66637 - DNA, 70 bp, Artificial Sequence
  Synthetic
gccaagcatttaggtgacactatagacatgttcggtcacccactcgtttcagagctatgctggaaacagc

SEQ ID NO: 66638 - DNA, 70 bp, Artificial Sequence
  Synthetic
gccaagcatttaggtgacactataggatctgcaagaacgatcggggtttcagagctatgctggaaacagc

SEQ ID NO: 66639 - DNA, 70 bp, Artificial Sequence
  Synthetic
gccaagcatttaggtgacactatagagcatctgtgccagctgagagtttcagagctatgctggaaacagc

SEQ ID NO: 66640 - DNA, 70 bp, Artificial Sequence
  Synthetic
gccaagcatttaggtgacactataggtctgtagaagacacagtgagtttcagagctatgctggaaacagc

SEQ ID NO: 66641 - DNA, 70 bp, Artificial Sequence
  Synthetic
gccaagcatttaggtgacactatagcacaagatgctcagctagatgtttcagagctatgctggaaacagc

SEQ ID NO: 66642 - DNA, 70 bp, Artificial Sequence
  Synthetic
gccaagcatttaggtgacactatagagccctcactgtgaaccctggtttcagagctatgctggaaacagc

SEQ ID NO: 66643 - DNA, 70 bp, Artificial Sequence
  Synthetic
gccaagcatttaggtgacactatagaggtgctacgtatctgctttgtttcagagctatgctggaaacagc

SEQ ID NO: 66644 - DNA, 70 bp, Artificial Sequence
  Synthetic
gccaagcatttaggtgacactatagcggcctcagggttcacagtggtttcagagctatgctggaaacagc

SEQ ID NO: 66645 - DNA, 70 bp, Artificial Sequence
  Synthetic
gccaagcatttaggtgacactatagggctgtaggggcaactaggggtttcagagctatgctggaaacagc

SEQ ID NO: 66646 - DNA, 70 bp, Artificial Sequence
  Synthetic
gccaagcatttaggtgacactatagcaggcaggaggtgactcagagtttcagagctatgctggaaacagc

SEQ ID NO: 66647 - DNA, 70 bp, Artificial Sequence
  Synthetic
gccaagcatttaggtgacactatagaccacagccagtggctcagagtttcagagctatgctggaaacagc

SEQ ID NO: 66648 - DNA, 70 bp, Artificial Sequence
  Synthetic
gccaagcatttaggtgacactatagcaccacctccaagcaaaaaggtttcagagctatgctggaaacagc

SEQ ID NO: 66649 - DNA, 70 bp, Artificial Sequence
  Synthetic
gccaagcatttaggtgacactataggtctttggagctgggactaagtttcagagctatgctggaaacagc

SEQ ID NO: 66650 - DNA, 70 bp, Artificial Sequence
  Synthetic
gccaagcatttaggtgacactatagggggtgtgggctaggttatagtttcagagctatgctggaaacagc

SEQ ID NO: 66651 - DNA, 70 bp, Artificial Sequence
  Synthetic
gccaagcatttaggtgacactatagaaattgcagactgctcctgcgtttcagagctatgctggaaacagc

SEQ ID NO: 66652 - DNA, 70 bp, Artificial Sequence
  Synthetic
gccaagcatttaggtgacactatagtctacgtttacctcaacatagtttcagagctatgctggaaacagc

SEQ ID NO: 66653 - DNA, 70 bp, Artificial Sequence
  Synthetic
gccaagcatttaggtgacactatagcatgttgtcctcagctaattgtttcagagctatgctggaaacagc

SEQ ID NO: 66654 - DNA, 70 bp, Artificial Sequence
  Synthetic
gccaagcatttaggtgacactataggtatggagaaaaagcagaaggtttcagagctatgctggaaacagc

SEQ ID NO: 66655 - DNA, 70 bp, Artificial Sequence
  Synthetic
gccaagcatttaggtgacactatagagaggaggatgagaagaatggtttcagagctatgctggaaacagc

SEQ ID NO: 66656 - DNA, 70 bp, Artificial Sequence
  Synthetic
gccaagcatttaggtgacactatagatctctgaaaacggagagctgtttcagagctatgctggaaacagc

SEQ ID NO: 66657 - DNA, 70 bp, Artificial Sequence
  Synthetic
gccaagcatttaggtgacactatagatctttctgacattgtgcttgtttcagagctatgctggaaacagc

SEQ ID NO: 66658 - DNA, 70 bp, Artificial Sequence
  Synthetic
gccaagcatttaggtgacactatagagggttccccaaagtgggaggtttcagagctatgctggaaacagc

SEQ ID NO: 66659 - DNA, 70 bp, Artificial Sequence
  Synthetic
gccaagcatttaggtgacactatagtttttgtgtgtacctatggggtttcagagctatgctggaaacagc

SEQ ID NO: 66660 - DNA, 70 bp, Artificial Sequence
  Synthetic
gccaagcatttaggtgacactatagttcagtcacatctgttcagtgtttcagagctatgctggaaacagc

SEQ ID NO: 66661 - DNA, 70 bp, Artificial Sequence
  Synthetic
gccaagcatttaggtgacactataggggacaagtattgaacataggtttcagagctatgctggaaacagc

SEQ ID NO: 66662 - DNA, 70 bp, Artificial Sequence
  Synthetic
gccaagcatttaggtgacactatagtgctcgcctcttggggcttcgtttcagagctatgctggaaacagc

SEQ ID NO: 66663 - DNA, 70 bp, Artificial Sequence
  Synthetic
gccaagcatttaggtgacactatagccacacactagacaccactcgtttcagagctatgctggaaacagc

SEQ ID NO: 66664 - DNA, 70 bp, Artificial Sequence
  Synthetic
gccaagcatttaggtgacactatagtcctcaaggaagtttaccttgtttcagagctatgctggaaacagc

SEQ ID NO: 66665 - DNA, 70 bp, Artificial Sequence
  Synthetic
gccaagcatttaggtgacactatagttacacctttgcagacttacgtttcagagctatgctggaaacagc

SEQ ID NO: 66666 - DNA, 70 bp, Artificial Sequence
  Synthetic
gccaagcatttaggtgacactatagagtgttatctcttcttttgcgtttcagagctatgctggaaacagc

SEQ ID NO: 66667 - DNA, 70 bp, Artificial Sequence
  Synthetic
gccaagcatttaggtgacactatagaaaggtggaacattatttgggtttcagagctatgctggaaacagc

SEQ ID NO: 66668 - DNA, 70 bp, Artificial Sequence
  Synthetic
gccaagcatttaggtgacactatagccctagaaaatccaactgaagtttcagagctatgctggaaacagc

SEQ ID NO: 66669 - DNA, 70 bp, Artificial Sequence
  Synthetic
gccaagcatttaggtgacactatagctgcagcggtctccctgaacgtttcagagctatgctggaaacagc

SEQ ID NO: 66670 - DNA, 70 bp, Artificial Sequence
  Synthetic
gccaagcatttaggtgacactatagaactggattgcttcaaaaacgtttcagagctatgctggaaacagc

SEQ ID NO: 66671 - DNA, 70 bp, Artificial Sequence
  Synthetic
gccaagcatttaggtgacactatagtttttttcagagtccagtctgtttcagagctatgctggaaacagc

SEQ ID NO: 66672 - DNA, 70 bp, Artificial Sequence
  Synthetic
gccaagcatttaggtgacactatagactggattaggcaacaaactgtttcagagctatgctggaaacagc

SEQ ID NO: 66673 - DNA, 70 bp, Artificial Sequence
  Synthetic
gccaagcatttaggtgacactataggagttacggccttgcgggacgtttcagagctatgctggaaacagc

SEQ ID NO: 66674 - DNA, 70 bp, Artificial Sequence
  Synthetic
gccaagcatttaggtgacactatagtcaaagactggtatgtagtggtttcagagctatgctggaaacagc

SEQ ID NO: 66675 - DNA, 70 bp, Artificial Sequence
  Synthetic
gccaagcatttaggtgacactatagaacataaagctatgaggatcgtttcagagctatgctggaaacagc

SEQ ID NO: 66676 - DNA, 70 bp, Artificial Sequence
  Synthetic
gccaagcatttaggtgacactatagtccctggatttacagcaagagtttcagagctatgctggaaacagc

SEQ ID NO: 66677 - DNA, 70 bp, Artificial Sequence
  Synthetic
gccaagcatttaggtgacactatagttagggaaactgaagcccaagtttcagagctatgctggaaacagc

SEQ ID NO: 66678 - DNA, 70 bp, Artificial Sequence
  Synthetic
gccaagcatttaggtgacactataggggtctcaaggtttaccgaagtttcagagctatgctggaaacagc

SEQ ID NO: 66679 - DNA, 70 bp, Artificial Sequence
  Synthetic
gccaagcatttaggtgacactatagactggatttatcgacaaatggtttcagagctatgctggaaacagc

SEQ ID NO: 66680 - DNA, 70 bp, Artificial Sequence
  Synthetic
gccaagcatttaggtgacactatagagagacctaaaaacctgaaggtttcagagctatgctggaaacagc

SEQ ID NO: 66681 - DNA, 70 bp, Artificial Sequence
  Synthetic
gccaagcatttaggtgacactatagagctcttcctttgtttcaaggtttcagagctatgctggaaacagc

SEQ ID NO: 66682 - DNA, 70 bp, Artificial Sequence
  Synthetic
gccaagcatttaggtgacactatagctggatctacaatgtctggagtttcagagctatgctggaaacagc

SEQ ID NO: 66683 - DNA, 70 bp, Artificial Sequence
  Synthetic
gccaagcatttaggtgacactataggaggaaacagcaggactcaggtttcagagctatgctggaaacagc

SEQ ID NO: 66684 - DNA, 70 bp, Artificial Sequence
  Synthetic
gccaagcatttaggtgacactatagatccagcaagtggtgacctggtttcagagctatgctggaaacagc

SEQ ID NO: 66685 - DNA, 70 bp, Artificial Sequence
  Synthetic
gccaagcatttaggtgacactatagagggacatatttatgaatccgtttcagagctatgctggaaacagc

SEQ ID NO: 66686 - DNA, 70 bp, Artificial Sequence
  Synthetic
gccaagcatttaggtgacactatagagtcacgtggtggtcactccgtttcagagctatgctggaaacagc

SEQ ID NO: 66687 - DNA, 70 bp, Artificial Sequence
  Synthetic
gccaagcatttaggtgacactatagcaaattctccggtttgccccgtttcagagctatgctggaaacagc

SEQ ID NO: 66688 - DNA, 70 bp, Artificial Sequence
  Synthetic
gccaagcatttaggtgacactataggaacacactctttctcttgcgtttcagagctatgctggaaacagc

SEQ ID NO: 66689 - DNA, 70 bp, Artificial Sequence
  Synthetic
gccaagcatttaggtgacactatagctggggcggcgcctgctagagtttcagagctatgctggaaacagc

SEQ ID NO: 66690 - DNA, 70 bp, Artificial Sequence
  Synthetic
gccaagcatttaggtgacactatagataccaaatttagcctggctgtttcagagctatgctggaaacagc

SEQ ID NO: 66691 - DNA, 70 bp, Artificial Sequence
  Synthetic
gccaagcatttaggtgacactataggaacacactctttctcctgcgtttcagagctatgctggaaacagc

SEQ ID NO: 66692 - DNA, 70 bp, Artificial Sequence
  Synthetic
gccaagcatttaggtgacactatagtggggtggaagaagtggggtgtttcagagctatgctggaaacagc

SEQ ID NO: 66693 - DNA, 70 bp, Artificial Sequence
  Synthetic
gccaagcatttaggtgacactatagttctcgatctcagccataccgtttcagagctatgctggaaacagc

SEQ ID NO: 66694 - DNA, 70 bp, Artificial Sequence
  Synthetic
gccaagcatttaggtgacactatagtttttctaggcgatccaattgtttcagagctatgctggaaacagc

SEQ ID NO: 66695 - DNA, 70 bp, Artificial Sequence
  Synthetic
gccaagcatttaggtgacactatagtggaacatcatggaaaaacagtttcagagctatgctggaaacagc

SEQ ID NO: 66696 - DNA, 70 bp, Artificial Sequence
  Synthetic
gccaagcatttaggtgacactatagactgagactggatcagaacagtttcagagctatgctggaaacagc

SEQ ID NO: 66697 - DNA, 70 bp, Artificial Sequence
  Synthetic
gccaagcatttaggtgacactatagagtaagatttcaagtgtggagtttcagagctatgctggaaacagc

SEQ ID NO: 66698 - DNA, 70 bp, Artificial Sequence
  Synthetic
gccaagcatttaggtgacactatagtcaggaactaaggagaattagtttcagagctatgctggaaacagc

SEQ ID NO: 66699 - DNA, 70 bp, Artificial Sequence
  Synthetic
gccaagcatttaggtgacactatagagcgcccgcggaggcactacgtttcagagctatgctggaaacagc

SEQ ID NO: 66700 - DNA, 70 bp, Artificial Sequence
  Synthetic
gccaagcatttaggtgacactatagttgcttctggggctattggagtttcagagctatgctggaaacagc

SEQ ID NO: 66701 - DNA, 70 bp, Artificial Sequence
  Synthetic
gccaagcatttaggtgacactatagtttgggatgtatggacgatagtttcagagctatgctggaaacagc

SEQ ID NO: 66702 - DNA, 70 bp, Artificial Sequence
  Synthetic
gccaagcatttaggtgacactataggatttatctgtggccaatgagtttcagagctatgctggaaacagc

SEQ ID NO: 66703 - DNA, 70 bp, Artificial Sequence
  Synthetic
gccaagcatttaggtgacactatagcgtcctttcttgtcaatctggtttcagagctatgctggaaacagc

SEQ ID NO: 66704 - DNA, 70 bp, Artificial Sequence
  Synthetic
gccaagcatttaggtgacactataggtcagatggggaaaacaagagtttcagagctatgctggaaacagc

SEQ ID NO: 66705 - DNA, 70 bp, Artificial Sequence
  Synthetic
gccaagcatttaggtgacactatagctcagaagaagtggttcctggtttcagagctatgctggaaacagc

SEQ ID NO: 66706 - DNA, 70 bp, Artificial Sequence
  Synthetic
gccaagcatttaggtgacactataggcctacagtgcaggagcccagtttcagagctatgctggaaacagc

SEQ ID NO: 66707 - DNA, 70 bp, Artificial Sequence
  Synthetic
gccaagcatttaggtgacactatagtctttgaaaacaagcacagcgtttcagagctatgctggaaacagc

SEQ ID NO: 66708 - DNA, 70 bp, Artificial Sequence
  Synthetic
gccaagcatttaggtgacactatagaaaagtcagcatgctgacaagtttcagagctatgctggaaacagc

SEQ ID NO: 66709 - DNA, 70 bp, Artificial Sequence
  Synthetic
gccaagcatttaggtgacactatagtcttgaaggcaggcgcaaacgtttcagagctatgctggaaacagc

SEQ ID NO: 66710 - DNA, 70 bp, Artificial Sequence
  Synthetic
gccaagcatttaggtgacactataggggatcattgccctgtgagggtttcagagctatgctggaaacagc

SEQ ID NO: 66711 - DNA, 70 bp, Artificial Sequence
  Synthetic
gccaagcatttaggtgacactataggagggtctggtcagtcgcgagtttcagagctatgctggaaacagc

SEQ ID NO: 66712 - DNA, 70 bp, Artificial Sequence
  Synthetic
gccaagcatttaggtgacactataggcccctattttcccttataagtttcagagctatgctggaaacagc

SEQ ID NO: 66713 - DNA, 70 bp, Artificial Sequence
  Synthetic
gccaagcatttaggtgacactatagcaagcagatgtatggctaacgtttcagagctatgctggaaacagc

SEQ ID NO: 66714 - DNA, 70 bp, Artificial Sequence
  Synthetic
gccaagcatttaggtgacactatagcctgtatccaaatccagtcagtttcagagctatgctggaaacagc

SEQ ID NO: 66715 - DNA, 70 bp, Artificial Sequence
  Synthetic
gccaagcatttaggtgacactatagtggggtttaaaattcccaaagtttcagagctatgctggaaacagc

SEQ ID NO: 66716 - DNA, 70 bp, Artificial Sequence
  Synthetic
gccaagcatttaggtgacactatagtgggcggcgccggggttcaggtttcagagctatgctggaaacagc

SEQ ID NO: 66717 - DNA, 70 bp, Artificial Sequence
  Synthetic
gccaagcatttaggtgacactatagtcaggaagctgctagacgaagtttcagagctatgctggaaacagc

SEQ ID NO: 66718 - DNA, 70 bp, Artificial Sequence
  Synthetic
gccaagcatttaggtgacactataggtaggagggaaggcatttaagtttcagagctatgctggaaacagc

SEQ ID NO: 66719 - DNA, 70 bp, Artificial Sequence
  Synthetic
gccaagcatttaggtgacactatagaaaaagagtctttcactccagtttcagagctatgctggaaacagc

SEQ ID NO: 66720 - DNA, 70 bp, Artificial Sequence
  Synthetic
gccaagcatttaggtgacactatagagagaatcacacttaggacagtttcagagctatgctggaaacagc

SEQ ID NO: 66721 - DNA, 70 bp, Artificial Sequence
  Synthetic
gccaagcatttaggtgacactatagtagaactatgatccctacgagtttcagagctatgctggaaacagc

SEQ ID NO: 66722 - DNA, 70 bp, Artificial Sequence
  Synthetic
gccaagcatttaggtgacactatagtcctgaagagattctttcacgtttcagagctatgctggaaacagc

SEQ ID NO: 66723 - DNA, 70 bp, Artificial Sequence
  Synthetic
gccaagcatttaggtgacactatagcatggggggcgctcaagcctgtttcagagctatgctggaaacagc

SEQ ID NO: 66724 - DNA, 70 bp, Artificial Sequence
  Synthetic
gccaagcatttaggtgacactatagtggccgcctaagtggagatagtttcagagctatgctggaaacagc

SEQ ID NO: 66725 - DNA, 70 bp, Artificial Sequence
  Synthetic
gccaagcatttaggtgacactatagtgtacattgtgaagctgtgagtttcagagctatgctggaaacagc

SEQ ID NO: 66726 - DNA, 70 bp, Artificial Sequence
  Synthetic
gccaagcatttaggtgacactatagggcagggggcacattgtcacgtttcagagctatgctggaaacagc

SEQ ID NO: 66727 - DNA, 70 bp, Artificial Sequence
  Synthetic
gccaagcatttaggtgacactataggggggcccaggtgcataaatgtttcagagctatgctggaaacagc

SEQ ID NO: 66728 - DNA, 70 bp, Artificial Sequence
  Synthetic
gccaagcatttaggtgacactatagggccctgagcaacaatagcagtttcagagctatgctggaaacagc

SEQ ID NO: 66729 - DNA, 70 bp, Artificial Sequence
  Synthetic
gccaagcatttaggtgacactataggtgcagagtctgtgggtcaggtttcagagctatgctggaaacagc

SEQ ID NO: 66730 - DNA, 70 bp, Artificial Sequence
  Synthetic
gccaagcatttaggtgacactatagtctggtgctgacattcctccgtttcagagctatgctggaaacagc

SEQ ID NO: 66731 - DNA, 70 bp, Artificial Sequence
  Synthetic
gccaagcatttaggtgacactataggccagctgctttgagtgctagtttcagagctatgctggaaacagc

SEQ ID NO: 66732 - DNA, 70 bp, Artificial Sequence
  Synthetic
gccaagcatttaggtgacactatagacggccaggctcacacccacgtttcagagctatgctggaaacagc

SEQ ID NO: 66733 - DNA, 70 bp, Artificial Sequence
  Synthetic
gccaagcatttaggtgacactataggatggggtggggtcttaggagtttcagagctatgctggaaacagc

SEQ ID NO: 66734 - DNA, 70 bp, Artificial Sequence
  Synthetic
gccaagcatttaggtgacactatagagccactcagacgtccctccgtttcagagctatgctggaaacagc

SEQ ID NO: 66735 - DNA, 70 bp, Artificial Sequence
  Synthetic
gccaagcatttaggtgacactatagtaagtcagtgctgtgttcacgtttcagagctatgctggaaacagc

SEQ ID NO: 66736 - DNA, 70 bp, Artificial Sequence
  Synthetic
gccaagcatttaggtgacactataggcgcccagtcttctcagatggtttcagagctatgctggaaacagc

SEQ ID NO: 66737 - DNA, 70 bp, Artificial Sequence
  Synthetic
gccaagcatttaggtgacactataggggatgaagcccagttaaccgtttcagagctatgctggaaacagc

SEQ ID NO: 66738 - DNA, 70 bp, Artificial Sequence
  Synthetic
gccaagcatttaggtgacactataggtatccctatgttctacagcgtttcagagctatgctggaaacagc

SEQ ID NO: 66739 - DNA, 70 bp, Artificial Sequence
  Synthetic
gccaagcatttaggtgacactatagcacgacagctaggaattacggtttcagagctatgctggaaacagc

SEQ ID NO: 66740 - DNA, 70 bp, Artificial Sequence
  Synthetic
gccaagcatttaggtgacactatagctgcagcgcggcccgtgacagtttcagagctatgctggaaacagc

SEQ ID NO: 66741 - DNA, 70 bp, Artificial Sequence
  Synthetic
gccaagcatttaggtgacactatagaccctggccaagatctgaccgtttcagagctatgctggaaacagc

SEQ ID NO: 66742 - DNA, 70 bp, Artificial Sequence
  Synthetic
gccaagcatttaggtgacactataggggggccaggatcagtgcacgtttcagagctatgctggaaacagc

SEQ ID NO: 66743 - DNA, 70 bp, Artificial Sequence
  Synthetic
gccaagcatttaggtgacactatagacagctgcctctggaaagtggtttcagagctatgctggaaacagc

SEQ ID NO: 66744 - DNA, 70 bp, Artificial Sequence
  Synthetic
gccaagcatttaggtgacactatagggaggatgtgaactgtgaaagtttcagagctatgctggaaacagc

SEQ ID NO: 66745 - DNA, 70 bp, Artificial Sequence
  Synthetic
gccaagcatttaggtgacactatagattcccaggagtttattttggtttcagagctatgctggaaacagc

SEQ ID NO: 66746 - DNA, 70 bp, Artificial Sequence
  Synthetic
gccaagcatttaggtgacactatagcagcaaggtagacttcaagagtttcagagctatgctggaaacagc

SEQ ID NO: 66747 - DNA, 70 bp, Artificial Sequence
  Synthetic
gccaagcatttaggtgacactatagttttttggggcctttttagtgtttcagagctatgctggaaacagc

SEQ ID NO: 66748 - DNA, 70 bp, Artificial Sequence
  Synthetic
gccaagcatttaggtgacactatagtcaggatgcaacatactttggtttcagagctatgctggaaacagc

SEQ ID NO: 66749 - DNA, 70 bp, Artificial Sequence
  Synthetic
gccaagcatttaggtgacactatagactcttccaggttcactgaggtttcagagctatgctggaaacagc

SEQ ID NO: 66750 - DNA, 70 bp, Artificial Sequence
  Synthetic
gccaagcatttaggtgacactatagtctccacatggaaccttcctgtttcagagctatgctggaaacagc

SEQ ID NO: 66751 - DNA, 70 bp, Artificial Sequence
  Synthetic
gccaagcatttaggtgacactatagatcacagtttcacaaaccccgtttcagagctatgctggaaacagc

SEQ ID NO: 66752 - DNA, 70 bp, Artificial Sequence
  Synthetic
gccaagcatttaggtgacactatagaatgcacaaatatcactggagtttcagagctatgctggaaacagc

SEQ ID NO: 66753 - DNA, 70 bp, Artificial Sequence
  Synthetic
gccaagcatttaggtgacactatagtcggggctttcatggtgtgagtttcagagctatgctggaaacagc

SEQ ID NO: 66754 - DNA, 70 bp, Artificial Sequence
  Synthetic
gccaagcatttaggtgacactatagtggagccttcttactatagggtttcagagctatgctggaaacagc

SEQ ID NO: 66755 - DNA, 70 bp, Artificial Sequence
  Synthetic
gccaagcatttaggtgacactatagcaagtctctaggagatgaatgtttcagagctatgctggaaacagc

SEQ ID NO: 66756 - DNA, 70 bp, Artificial Sequence
  Synthetic
gccaagcatttaggtgacactatagtattgccatcagcccctcaagtttcagagctatgctggaaacagc

SEQ ID NO: 66757 - DNA, 70 bp, Artificial Sequence
  Synthetic
gccaagcatttaggtgacactatagatggacaacacattctcaaggtttcagagctatgctggaaacagc

SEQ ID NO: 66758 - DNA, 70 bp, Artificial Sequence
  Synthetic
gccaagcatttaggtgacactatagttcagggttgtagagtttcagtttcagagctatgctggaaacagc

SEQ ID NO: 66759 - DNA, 70 bp, Artificial Sequence
  Synthetic
gccaagcatttaggtgacactataggctggacgttattccgacctgtttcagagctatgctggaaacagc

SEQ ID NO: 66760 - DNA, 70 bp, Artificial Sequence
  Synthetic
gccaagcatttaggtgacactatagacagaaattccatgatgaacgtttcagagctatgctggaaacagc

SEQ ID NO: 66761 - DNA, 70 bp, Artificial Sequence
  Synthetic
gccaagcatttaggtgacactatagctgtgggagggtccatcactgtttcagagctatgctggaaacagc

SEQ ID NO: 66762 - DNA, 70 bp, Artificial Sequence
  Synthetic
gccaagcatttaggtgacactatagcttggcaatctgagatcagcgtttcagagctatgctggaaacagc

SEQ ID NO: 66763 - DNA, 70 bp, Artificial Sequence
  Synthetic
gccaagcatttaggtgacactataggacacaatctggtctcactggtttcagagctatgctggaaacagc

SEQ ID NO: 66764 - DNA, 70 bp, Artificial Sequence
  Synthetic
gccaagcatttaggtgacactataggcaagtggcttctagtttctgtttcagagctatgctggaaacagc

SEQ ID NO: 66765 - DNA, 70 bp, Artificial Sequence
  Synthetic
gccaagcatttaggtgacactatagcacgggtgagtctcggtcacgtttcagagctatgctggaaacagc

SEQ ID NO: 66766 - DNA, 70 bp, Artificial Sequence
  Synthetic
gccaagcatttaggtgacactatagcggatggactttctttactggtttcagagctatgctggaaacagc

SEQ ID NO: 66767 - DNA, 70 bp, Artificial Sequence
  Synthetic
gccaagcatttaggtgacactatagttagtgtgtacttctacggagtttcagagctatgctggaaacagc

SEQ ID NO: 66768 - DNA, 70 bp, Artificial Sequence
  Synthetic
gccaagcatttaggtgacactatagcagaagctgagctcagggccgtttcagagctatgctggaaacagc

SEQ ID NO: 66769 - DNA, 70 bp, Artificial Sequence
  Synthetic
gccaagcatttaggtgacactatagcttgtggtgggcagggccccgtttcagagctatgctggaaacagc

SEQ ID NO: 66770 - DNA, 70 bp, Artificial Sequence
  Synthetic
gccaagcatttaggtgacactatagtcactaggtcttctgctctggtttcagagctatgctggaaacagc

SEQ ID NO: 66771 - DNA, 70 bp, Artificial Sequence
  Synthetic
gccaagcatttaggtgacactatagcctgaaactgaagaagaagagtttcagagctatgctggaaacagc

SEQ ID NO: 66772 - DNA, 70 bp, Artificial Sequence
  Synthetic
gccaagcatttaggtgacactatagaggcctgaaggtatggtcgagtttcagagctatgctggaaacagc

SEQ ID NO: 66773 - DNA, 70 bp, Artificial Sequence
  Synthetic
gccaagcatttaggtgacactatagcatgctggggagggtctaatgtttcagagctatgctggaaacagc

SEQ ID NO: 66774 - DNA, 70 bp, Artificial Sequence
  Synthetic
gccaagcatttaggtgacactataggaaggctgcgaacgttctgagtttcagagctatgctggaaacagc

SEQ ID NO: 66775 - DNA, 70 bp, Artificial Sequence
  Synthetic
gccaagcatttaggtgacactatagcctggagttcatgaagggtggtttcagagctatgctggaaacagc

SEQ ID NO: 66776 - DNA, 70 bp, Artificial Sequence
  Synthetic
gccaagcatttaggtgacactatagatgatggagggcgtgcagtagtttcagagctatgctggaaacagc

SEQ ID NO: 66777 - DNA, 70 bp, Artificial Sequence
  Synthetic
gccaagcatttaggtgacactatagagtctccgacctcacaataggtttcagagctatgctggaaacagc

SEQ ID NO: 66778 - DNA, 70 bp, Artificial Sequence
  Synthetic
gccaagcatttaggtgacactataggatgtttgagtccgagtcctgtttcagagctatgctggaaacagc

SEQ ID NO: 66779 - DNA, 70 bp, Artificial Sequence
  Synthetic
gccaagcatttaggtgacactatagagctctcaaactttttcttggtttcagagctatgctggaaacagc

SEQ ID NO: 66780 - DNA, 70 bp, Artificial Sequence
  Synthetic
gccaagcatttaggtgacactatagccgaaatagtagcagctttggtttcagagctatgctggaaacagc

SEQ ID NO: 66781 - DNA, 70 bp, Artificial Sequence
  Synthetic
gccaagcatttaggtgacactataggttggaggccgctggaagtggtttcagagctatgctggaaacagc

SEQ ID NO: 66782 - DNA, 70 bp, Artificial Sequence
  Synthetic
gccaagcatttaggtgacactatagcaggctctatttccagcgccgtttcagagctatgctggaaacagc

SEQ ID NO: 66783 - DNA, 70 bp, Artificial Sequence
  Synthetic
gccaagcatttaggtgacactatagggcgggcgctggaagtagaggtttcagagctatgctggaaacagc

SEQ ID NO: 66784 - DNA, 70 bp, Artificial Sequence
  Synthetic
gccaagcatttaggtgacactatagatgccagttgtgacgaaatggtttcagagctatgctggaaacagc

SEQ ID NO: 66785 - DNA, 70 bp, Artificial Sequence
  Synthetic
gccaagcatttaggtgacactatagaggagtgcggtctcattagtgtttcagagctatgctggaaacagc

SEQ ID NO: 66786 - DNA, 70 bp, Artificial Sequence
  Synthetic
gccaagcatttaggtgacactataggagcgtcttgcagctttttagtttcagagctatgctggaaacagc

SEQ ID NO: 66787 - DNA, 70 bp, Artificial Sequence
  Synthetic
gccaagcatttaggtgacactatagggcggctttctatggggtctgtttcagagctatgctggaaacagc

SEQ ID NO: 66788 - DNA, 70 bp, Artificial Sequence
  Synthetic
gccaagcatttaggtgacactatagtgtgagctatcgaaacaaccgtttcagagctatgctggaaacagc

SEQ ID NO: 66789 - DNA, 70 bp, Artificial Sequence
  Synthetic
gccaagcatttaggtgacactataggcccactgctcagaactgtagtttcagagctatgctggaaacagc

SEQ ID NO: 66790 - DNA, 70 bp, Artificial Sequence
  Synthetic
gccaagcatttaggtgacactatagccggcgggctcagcagagcagtttcagagctatgctggaaacagc

SEQ ID NO: 66791 - DNA, 70 bp, Artificial Sequence
  Synthetic
gccaagcatttaggtgacactatagtctgcatctacactgttacagtttcagagctatgctggaaacagc

SEQ ID NO: 66792 - DNA, 70 bp, Artificial Sequence
  Synthetic
gccaagcatttaggtgacactatagtgaccttctgggaggagggtgtttcagagctatgctggaaacagc

SEQ ID NO: 66793 - DNA, 70 bp, Artificial Sequence
  Synthetic
gccaagcatttaggtgacactatagctgatgatggcagagcctacgtttcagagctatgctggaaacagc

SEQ ID NO: 66794 - DNA, 70 bp, Artificial Sequence
  Synthetic
gccaagcatttaggtgacactatagggggcagggttcatctctttgtttcagagctatgctggaaacagc

SEQ ID NO: 66795 - DNA, 70 bp, Artificial Sequence
  Synthetic
gccaagcatttaggtgacactatagtactgggccagagaaaatgagtttcagagctatgctggaaacagc

SEQ ID NO: 66796 - DNA, 70 bp, Artificial Sequence
  Synthetic
gccaagcatttaggtgacactataggggagttctcagaccttcttgtttcagagctatgctggaaacagc

SEQ ID NO: 66797 - DNA, 70 bp, Artificial Sequence
  Synthetic
gccaagcatttaggtgacactatagaggacgcagaaaggatgtaggtttcagagctatgctggaaacagc

SEQ ID NO: 66798 - DNA, 70 bp, Artificial Sequence
  Synthetic
gccaagcatttaggtgacactatagtttcgctccccagcgggggggtttcagagctatgctggaaacagc

SEQ ID NO: 66799 - DNA, 70 bp, Artificial Sequence
  Synthetic
gccaagcatttaggtgacactatagccagcaattccagcctgttagtttcagagctatgctggaaacagc

SEQ ID NO: 66800 - DNA, 70 bp, Artificial Sequence
  Synthetic
gccaagcatttaggtgacactatagcgggcaggtagatggtcagtgtttcagagctatgctggaaacagc

SEQ ID NO: 66801 - DNA, 70 bp, Artificial Sequence
  Synthetic
gccaagcatttaggtgacactatagcagaagatgaagctcacttggtttcagagctatgctggaaacagc

SEQ ID NO: 66802 - DNA, 70 bp, Artificial Sequence
  Synthetic
gccaagcatttaggtgacactataggggtcagaatctgttaaatcgtttcagagctatgctggaaacagc

SEQ ID NO: 66803 - DNA, 70 bp, Artificial Sequence
  Synthetic
gccaagcatttaggtgacactatagcagctcatacccttttcagcgtttcagagctatgctggaaacagc

SEQ ID NO: 66804 - DNA, 70 bp, Artificial Sequence
  Synthetic
gccaagcatttaggtgacactatagacatcacaaaatgccatgaagtttcagagctatgctggaaacagc

SEQ ID NO: 66805 - DNA, 70 bp, Artificial Sequence
  Synthetic
gccaagcatttaggtgacactatagctccctgctgcagatggggggtttcagagctatgctggaaacagc

SEQ ID NO: 66806 - DNA, 70 bp, Artificial Sequence
  Synthetic
gccaagcatttaggtgacactatagtgccagaccccacactcatagtttcagagctatgctggaaacagc

SEQ ID NO: 66807 - DNA, 70 bp, Artificial Sequence
  Synthetic
gccaagcatttaggtgacactatagcacaaaggagctcaaaatgagtttcagagctatgctggaaacagc

SEQ ID NO: 66808 - DNA, 70 bp, Artificial Sequence
  Synthetic
gccaagcatttaggtgacactatagggtgttgagttctcccagaggtttcagagctatgctggaaacagc

SEQ ID NO: 66809 - DNA, 70 bp, Artificial Sequence
  Synthetic
gccaagcatttaggtgacactatagcaaaccacagagctgctcacgtttcagagctatgctggaaacagc

SEQ ID NO: 66810 - DNA, 70 bp, Artificial Sequence
  Synthetic
gccaagcatttaggtgacactataggagcttggctgaagatgatggtttcagagctatgctggaaacagc

SEQ ID NO: 66811 - DNA, 70 bp, Artificial Sequence
  Synthetic
gccaagcatttaggtgacactataggaatgaacaggactgcttgggtttcagagctatgctggaaacagc

SEQ ID NO: 66812 - DNA, 70 bp, Artificial Sequence
  Synthetic
gccaagcatttaggtgacactatagggggctctaccctcacttccgtttcagagctatgctggaaacagc

SEQ ID NO: 66813 - DNA, 70 bp, Artificial Sequence
  Synthetic
gccaagcatttaggtgacactatagccctgttgggtttttagtgtgtttcagagctatgctggaaacagc

SEQ ID NO: 66814 - DNA, 70 bp, Artificial Sequence
  Synthetic
gccaagcatttaggtgacactatagggccaggagggctcagccgagtttcagagctatgctggaaacagc

SEQ ID NO: 66815 - DNA, 70 bp, Artificial Sequence
  Synthetic
gccaagcatttaggtgacactatagttcagcatcactgtgggctggtttcagagctatgctggaaacagc

SEQ ID NO: 66816 - DNA, 70 bp, Artificial Sequence
  Synthetic
gccaagcatttaggtgacactatagacggaactttctcatctacggtttcagagctatgctggaaacagc

SEQ ID NO: 66817 - DNA, 70 bp, Artificial Sequence
  Synthetic
gccaagcatttaggtgacactataggaaggcgacgggcatatgcggtttcagagctatgctggaaacagc

SEQ ID NO: 66818 - DNA, 70 bp, Artificial Sequence
  Synthetic
gccaagcatttaggtgacactatagttaactctaaggggtcatcggtttcagagctatgctggaaacagc

SEQ ID NO: 66819 - DNA, 70 bp, Artificial Sequence
  Synthetic
gccaagcatttaggtgacactatagcctcatggcacctcagccaggtttcagagctatgctggaaacagc

SEQ ID NO: 66820 - DNA, 70 bp, Artificial Sequence
  Synthetic
gccaagcatttaggtgacactatagtgagcctactttggggataagtttcagagctatgctggaaacagc

SEQ ID NO: 66821 - DNA, 70 bp, Artificial Sequence
  Synthetic
gccaagcatttaggtgacactatagttccccctgttttataatgtgtttcagagctatgctggaaacagc

SEQ ID NO: 66822 - DNA, 70 bp, Artificial Sequence
  Synthetic
gccaagcatttaggtgacactatagaaaggcagcgccagggtcaggtttcagagctatgctggaaacagc

SEQ ID NO: 66823 - DNA, 70 bp, Artificial Sequence
  Synthetic
gccaagcatttaggtgacactataggtttgcctgggccattgacagtttcagagctatgctggaaacagc

SEQ ID NO: 66824 - DNA, 70 bp, Artificial Sequence
  Synthetic
gccaagcatttaggtgacactatagttcaaagtcttctcctgccagtttcagagctatgctggaaacagc

SEQ ID NO: 66825 - DNA, 70 bp, Artificial Sequence
  Synthetic
gccaagcatttaggtgacactatagcatcttcatctgactcttccgtttcagagctatgctggaaacagc

SEQ ID NO: 66826 - DNA, 70 bp, Artificial Sequence
  Synthetic
gccaagcatttaggtgacactatagtgccacgaaccggtcgggctgtttcagagctatgctggaaacagc

SEQ ID NO: 66827 - DNA, 70 bp, Artificial Sequence
  Synthetic
gccaagcatttaggtgacactatagccctgagctcatctgttctggtttcagagctatgctggaaacagc

SEQ ID NO: 66828 - DNA, 70 bp, Artificial Sequence
  Synthetic
gccaagcatttaggtgacactatagacagggtcatcatacaaagtgtttcagagctatgctggaaacagc

SEQ ID NO: 66829 - DNA, 70 bp, Artificial Sequence
  Synthetic
gccaagcatttaggtgacactataggcaccaggctggactctgaggtttcagagctatgctggaaacagc

SEQ ID NO: 66830 - DNA, 70 bp, Artificial Sequence
  Synthetic
gccaagcatttaggtgacactatagtgaagtgggctggaaaggttgtttcagagctatgctggaaacagc

SEQ ID NO: 66831 - DNA, 70 bp, Artificial Sequence
  Synthetic
gccaagcatttaggtgacactatagagatgcgattagtgtactctgtttcagagctatgctggaaacagc

SEQ ID NO: 66832 - DNA, 70 bp, Artificial Sequence
  Synthetic
gccaagcatttaggtgacactatagactgacattaatgatgtccggtttcagagctatgctggaaacagc

SEQ ID NO: 66833 - DNA, 70 bp, Artificial Sequence
  Synthetic
gccaagcatttaggtgacactatagctcagataaaggctgcaaaagtttcagagctatgctggaaacagc

SEQ ID NO: 66834 - DNA, 70 bp, Artificial Sequence
  Synthetic
gccaagcatttaggtgacactatagcctgaaaatgccctgaaaaggtttcagagctatgctggaaacagc

SEQ ID NO: 66835 - DNA, 70 bp, Artificial Sequence
  Synthetic
gccaagcatttaggtgacactatagtctgtgcttagctttagaaagtttcagagctatgctggaaacagc

SEQ ID NO: 66836 - DNA, 70 bp, Artificial Sequence
  Synthetic
gccaagcatttaggtgacactatagttggcccagttttttgtttagtttcagagctatgctggaaacagc

SEQ ID NO: 66837 - DNA, 70 bp, Artificial Sequence
  Synthetic
gccaagcatttaggtgacactatagagttttatcttctgctcatggtttcagagctatgctggaaacagc

SEQ ID NO: 66838 - DNA, 70 bp, Artificial Sequence
  Synthetic
gccaagcatttaggtgacactatagccatctggataggagctcaggtttcagagctatgctggaaacagc

SEQ ID NO: 66839 - DNA, 70 bp, Artificial Sequence
  Synthetic
gccaagcatttaggtgacactataggaaagatgaagatggctttggtttcagagctatgctggaaacagc

SEQ ID NO: 66840 - DNA, 70 bp, Artificial Sequence
  Synthetic
gccaagcatttaggtgacactataggacaccactcagagagtcaggtttcagagctatgctggaaacagc

SEQ ID NO: 66841 - DNA, 70 bp, Artificial Sequence
  Synthetic
gccaagcatttaggtgacactataggggcctggagccaagggatggtttcagagctatgctggaaacagc

SEQ ID NO: 66842 - DNA, 70 bp, Artificial Sequence
  Synthetic
gccaagcatttaggtgacactatagtgtccaaagggaaatcaaccgtttcagagctatgctggaaacagc

SEQ ID NO: 66843 - DNA, 70 bp, Artificial Sequence
  Synthetic
gccaagcatttaggtgacactatagttaactacttcctgtcatgagtttcagagctatgctggaaacagc

SEQ ID NO: 66844 - DNA, 70 bp, Artificial Sequence
  Synthetic
gccaagcatttaggtgacactatagccgtcctgcgcctccactacgtttcagagctatgctggaaacagc

SEQ ID NO: 66845 - DNA, 70 bp, Artificial Sequence
  Synthetic
gccaagcatttaggtgacactatagggtgttcagattctcaagtagtttcagagctatgctggaaacagc

SEQ ID NO: 66846 - DNA, 70 bp, Artificial Sequence
  Synthetic
gccaagcatttaggtgacactatagtagggaggcgggattaggtggtttcagagctatgctggaaacagc

SEQ ID NO: 66847 - DNA, 70 bp, Artificial Sequence
  Synthetic
gccaagcatttaggtgacactatagacagactcaagtattatcgcgtttcagagctatgctggaaacagc

SEQ ID NO: 66848 - DNA, 70 bp, Artificial Sequence
  Synthetic
gccaagcatttaggtgacactatagtgaatttctagaggctacccgtttcagagctatgctggaaacagc

SEQ ID NO: 66849 - DNA, 70 bp, Artificial Sequence
  Synthetic
gccaagcatttaggtgacactatagcaacttacgacgagtttatcgtttcagagctatgctggaaacagc

SEQ ID NO: 66850 - DNA, 70 bp, Artificial Sequence
  Synthetic
gccaagcatttaggtgacactatagggagaatgtcagtctgagtcgtttcagagctatgctggaaacagc

SEQ ID NO: 66851 - DNA, 70 bp, Artificial Sequence
  Synthetic
gccaagcatttaggtgacactatagtttctttttgaaagctggtcgtttcagagctatgctggaaacagc

SEQ ID NO: 66852 - DNA, 70 bp, Artificial Sequence
  Synthetic
gccaagcatttaggtgacactatagcttggtcctcagcaactgtcgtttcagagctatgctggaaacagc

SEQ ID NO: 66853 - DNA, 70 bp, Artificial Sequence
  Synthetic
gccaagcatttaggtgacactatagtcagagcattggacagagctgtttcagagctatgctggaaacagc

SEQ ID NO: 66854 - DNA, 70 bp, Artificial Sequence
  Synthetic
gccaagcatttaggtgacactatagtcggctcactgcaacctcaagtttcagagctatgctggaaacagc

SEQ ID NO: 66855 - DNA, 70 bp, Artificial Sequence
  Synthetic
gccaagcatttaggtgacactatagctcattgttggggagagaatgtttcagagctatgctggaaacagc

SEQ ID NO: 66856 - DNA, 70 bp, Artificial Sequence
  Synthetic
gccaagcatttaggtgacactatagtaaaccaagacaaaggagctgtttcagagctatgctggaaacagc

SEQ ID NO: 66857 - DNA, 70 bp, Artificial Sequence
  Synthetic
gccaagcatttaggtgacactatagagcgggcaactaggccttctgtttcagagctatgctggaaacagc

SEQ ID NO: 66858 - DNA, 70 bp, Artificial Sequence
  Synthetic
gccaagcatttaggtgacactatagcagtgtaggagtcaggttctgtttcagagctatgctggaaacagc

SEQ ID NO: 66859 - DNA, 70 bp, Artificial Sequence
  Synthetic
gccaagcatttaggtgacactatagggtagcaagagacagatgccgtttcagagctatgctggaaacagc

SEQ ID NO: 66860 - DNA, 70 bp, Artificial Sequence
  Synthetic
gccaagcatttaggtgacactatagaaggcgagagctcggagtgagtttcagagctatgctggaaacagc

SEQ ID NO: 66861 - DNA, 70 bp, Artificial Sequence
  Synthetic
gccaagcatttaggtgacactatagcctgccccatcctccttcacgtttcagagctatgctggaaacagc

SEQ ID NO: 66862 - DNA, 70 bp, Artificial Sequence
  Synthetic
gccaagcatttaggtgacactataggttggcctccatgtacttatgtttcagagctatgctggaaacagc

SEQ ID NO: 66863 - DNA, 70 bp, Artificial Sequence
  Synthetic
gccaagcatttaggtgacactatagattagtaattgtactgacgcgtttcagagctatgctggaaacagc

SEQ ID NO: 66864 - DNA, 70 bp, Artificial Sequence
  Synthetic
gccaagcatttaggtgacactataggtcttataagcagcttttccgtttcagagctatgctggaaacagc

SEQ ID NO: 66865 - DNA, 70 bp, Artificial Sequence
  Synthetic
gccaagcatttaggtgacactatagtggacgctcagtagttgaacgtttcagagctatgctggaaacagc

SEQ ID NO: 66866 - DNA, 70 bp, Artificial Sequence
  Synthetic
gccaagcatttaggtgacactatagcacattcttctacccaaccagtttcagagctatgctggaaacagc

SEQ ID NO: 66867 - DNA, 70 bp, Artificial Sequence
  Synthetic
gccaagcatttaggtgacactatagctctcactgcctccgcggcagtttcagagctatgctggaaacagc

SEQ ID NO: 66868 - DNA, 70 bp, Artificial Sequence
  Synthetic
gccaagcatttaggtgacactatagagctgaaggggaggaatggggtttcagagctatgctggaaacagc

SEQ ID NO: 66869 - DNA, 70 bp, Artificial Sequence
  Synthetic
gccaagcatttaggtgacactatagacaaccattcctgatggcatgtttcagagctatgctggaaacagc

SEQ ID NO: 66870 - DNA, 70 bp, Artificial Sequence
  Synthetic
gccaagcatttaggtgacactatagacagcgcatcaaagaggagggtttcagagctatgctggaaacagc

SEQ ID NO: 66871 - DNA, 70 bp, Artificial Sequence
  Synthetic
gccaagcatttaggtgacactatagatatagagatagggctctatgtttcagagctatgctggaaacagc

SEQ ID NO: 66872 - DNA, 70 bp, Artificial Sequence
  Synthetic
gccaagcatttaggtgacactatagccacagattgcagcattgtcgtttcagagctatgctggaaacagc

SEQ ID NO: 66873 - DNA, 70 bp, Artificial Sequence
  Synthetic
gccaagcatttaggtgacactatagcagccaggcgaggccctcaggtttcagagctatgctggaaacagc

SEQ ID NO: 66874 - DNA, 70 bp, Artificial Sequence
  Synthetic
gccaagcatttaggtgacactatagcctgcagaacctgaccattggtttcagagctatgctggaaacagc

SEQ ID NO: 66875 - DNA, 70 bp, Artificial Sequence
  Synthetic
gccaagcatttaggtgacactatagcggggatcttcagggcccccgtttcagagctatgctggaaacagc

SEQ ID NO: 66876 - DNA, 70 bp, Artificial Sequence
  Synthetic
gccaagcatttaggtgacactatagaacgaacctcagttctaactgtttcagagctatgctggaaacagc

SEQ ID NO: 66877 - DNA, 70 bp, Artificial Sequence
  Synthetic
gccaagcatttaggtgacactatagcccgggctcggggctctgaggtttcagagctatgctggaaacagc

SEQ ID NO: 66878 - DNA, 70 bp, Artificial Sequence
  Synthetic
gccaagcatttaggtgacactatagtcgggcgctgggctaggtaagtttcagagctatgctggaaacagc

SEQ ID NO: 66879 - DNA, 70 bp, Artificial Sequence
  Synthetic
gccaagcatttaggtgacactatagacccgcacctgtggctgtgcgtttcagagctatgctggaaacagc

SEQ ID NO: 66880 - DNA, 70 bp, Artificial Sequence
  Synthetic
gccaagcatttaggtgacactatagaacaaaggtaggaatctcacgtttcagagctatgctggaaacagc

SEQ ID NO: 66881 - DNA, 70 bp, Artificial Sequence
  Synthetic
gccaagcatttaggtgacactatagctcagtcatcaccaaaaagcgtttcagagctatgctggaaacagc

SEQ ID NO: 66882 - DNA, 70 bp, Artificial Sequence
  Synthetic
gccaagcatttaggtgacactatagacggccatcagcaagaagttgtttcagagctatgctggaaacagc

SEQ ID NO: 66883 - DNA, 70 bp, Artificial Sequence
  Synthetic
gccaagcatttaggtgacactatagctcccggcggaccaaggagggtttcagagctatgctggaaacagc

SEQ ID NO: 66884 - DNA, 70 bp, Artificial Sequence
  Synthetic
gccaagcatttaggtgacactatagtagcaggcatacttatggaagtttcagagctatgctggaaacagc

SEQ ID NO: 66885 - DNA, 70 bp, Artificial Sequence
  Synthetic
gccaagcatttaggtgacactatagaagcaaccacaggcttagaagtttcagagctatgctggaaacagc

SEQ ID NO: 66886 - DNA, 70 bp, Artificial Sequence
  Synthetic
gccaagcatttaggtgacactatagccggctctgctcatccgcccgtttcagagctatgctggaaacagc

SEQ ID NO: 66887 - DNA, 70 bp, Artificial Sequence
  Synthetic
gccaagcatttaggtgacactatagattctgcttccttctcctttgtttcagagctatgctggaaacagc

SEQ ID NO: 66888 - DNA, 70 bp, Artificial Sequence
  Synthetic
gccaagcatttaggtgacactataggcttggaggcgtgaagaagtgtttcagagctatgctggaaacagc

SEQ ID NO: 66889 - DNA, 70 bp, Artificial Sequence
  Synthetic
gccaagcatttaggtgacactatagtctcagggggcaaaagagctgtttcagagctatgctggaaacagc

SEQ ID NO: 66890 - DNA, 70 bp, Artificial Sequence
  Synthetic
gccaagcatttaggtgacactatagaaggtcaagccggtgggctggtttcagagctatgctggaaacagc

SEQ ID NO: 66891 - DNA, 70 bp, Artificial Sequence
  Synthetic
gccaagcatttaggtgacactataggagggaggggtgctcacttcgtttcagagctatgctggaaacagc

SEQ ID NO: 66892 - DNA, 70 bp, Artificial Sequence
  Synthetic
gccaagcatttaggtgacactatagataccatagtttacaatggcgtttcagagctatgctggaaacagc

SEQ ID NO: 66893 - DNA, 70 bp, Artificial Sequence
  Synthetic
gccaagcatttaggtgacactatagcttcatgtgtatcgtcctccgtttcagagctatgctggaaacagc

SEQ ID NO: 66894 - DNA, 70 bp, Artificial Sequence
  Synthetic
gccaagcatttaggtgacactataggaacaggaatccggagcagagtttcagagctatgctggaaacagc

SEQ ID NO: 66895 - DNA, 70 bp, Artificial Sequence
  Synthetic
gccaagcatttaggtgacactatagtccaagcgagggtgcttctggtttcagagctatgctggaaacagc

SEQ ID NO: 66896 - DNA, 70 bp, Artificial Sequence
  Synthetic
gccaagcatttaggtgacactatagtcgcaatcattcctcagttagtttcagagctatgctggaaacagc

SEQ ID NO: 66897 - DNA, 70 bp, Artificial Sequence
  Synthetic
gccaagcatttaggtgacactatagtgctgctgactctttgcttggtttcagagctatgctggaaacagc

SEQ ID NO: 66898 - DNA, 70 bp, Artificial Sequence
  Synthetic
gccaagcatttaggtgacactatagactggctactgttagatactgtttcagagctatgctggaaacagc

SEQ ID NO: 66899 - DNA, 70 bp, Artificial Sequence
  Synthetic
gccaagcatttaggtgacactatagggcatcaaatccccagatatgtttcagagctatgctggaaacagc

SEQ ID NO: 66900 - DNA, 70 bp, Artificial Sequence
  Synthetic
gccaagcatttaggtgacactataggatggatggggctcattgttgtttcagagctatgctggaaacagc

SEQ ID NO: 66901 - DNA, 70 bp, Artificial Sequence
  Synthetic
gccaagcatttaggtgacactataggtcaacaggttagcttttgagtttcagagctatgctggaaacagc

SEQ ID NO: 66902 - DNA, 70 bp, Artificial Sequence
  Synthetic
gccaagcatttaggtgacactatagtaatctgattagtcttgggagtttcagagctatgctggaaacagc

SEQ ID NO: 66903 - DNA, 70 bp, Artificial Sequence
  Synthetic
gccaagcatttaggtgacactatagaagtcatatcgttgagagcggtttcagagctatgctggaaacagc

SEQ ID NO: 66904 - DNA, 70 bp, Artificial Sequence
  Synthetic
gccaagcatttaggtgacactatagactaaagctggccctgaatggtttcagagctatgctggaaacagc

SEQ ID NO: 66905 - DNA, 70 bp, Artificial Sequence
  Synthetic
gccaagcatttaggtgacactatagagagtggatgaacgtttacagtttcagagctatgctggaaacagc

SEQ ID NO: 66906 - DNA, 70 bp, Artificial Sequence
  Synthetic
gccaagcatttaggtgacactataggatgctggatcagactttacgtttcagagctatgctggaaacagc

SEQ ID NO: 66907 - DNA, 70 bp, Artificial Sequence
  Synthetic
gccaagcatttaggtgacactatagcacgctggcgtggggctcaggtttcagagctatgctggaaacagc

SEQ ID NO: 66908 - DNA, 70 bp, Artificial Sequence
  Synthetic
gccaagcatttaggtgacactatagggggtggggctggccctcacgtttcagagctatgctggaaacagc

SEQ ID NO: 66909 - DNA, 70 bp, Artificial Sequence
  Synthetic
gccaagcatttaggtgacactatagaggtcatgtcattgagggcggtttcagagctatgctggaaacagc

SEQ ID NO: 66910 - DNA, 70 bp, Artificial Sequence
  Synthetic
gccaagcatttaggtgacactataggcatgatctgtgtgactgatgtttcagagctatgctggaaacagc

SEQ ID NO: 66911 - DNA, 70 bp, Artificial Sequence
  Synthetic
gccaagcatttaggtgacactataggggcgttctacatctcattcgtttcagagctatgctggaaacagc

SEQ ID NO: 66912 - DNA, 70 bp, Artificial Sequence
  Synthetic
gccaagcatttaggtgacactatagcgtgggcttacatcagacacgtttcagagctatgctggaaacagc

SEQ ID NO: 66913 - DNA, 70 bp, Artificial Sequence
  Synthetic
gccaagcatttaggtgacactatagtatgatccaactaaacatccgtttcagagctatgctggaaacagc

SEQ ID NO: 66914 - DNA, 70 bp, Artificial Sequence
  Synthetic
gccaagcatttaggtgacactatagttccacatgctgaaattgaagtttcagagctatgctggaaacagc

SEQ ID NO: 66915 - DNA, 70 bp, Artificial Sequence
  Synthetic
gccaagcatttaggtgacactatagtcctgccactttgccctcaggtttcagagctatgctggaaacagc

SEQ ID NO: 66916 - DNA, 70 bp, Artificial Sequence
  Synthetic
gccaagcatttaggtgacactatagtcctgataggaaagggtcaggtttcagagctatgctggaaacagc

SEQ ID NO: 66917 - DNA, 70 bp, Artificial Sequence
  Synthetic
gccaagcatttaggtgacactatagtagaatacgcaataatcggggtttcagagctatgctggaaacagc

SEQ ID NO: 66918 - DNA, 70 bp, Artificial Sequence
  Synthetic
gccaagcatttaggtgacactatagaggctcgccaggccctgatcgtttcagagctatgctggaaacagc

SEQ ID NO: 66919 - DNA, 70 bp, Artificial Sequence
  Synthetic
gccaagcatttaggtgacactataggataagaagaccaagtagaggtttcagagctatgctggaaacagc

SEQ ID NO: 66920 - DNA, 70 bp, Artificial Sequence
  Synthetic
gccaagcatttaggtgacactataggatgccaaggtgaagaagtggtttcagagctatgctggaaacagc

SEQ ID NO: 66921 - DNA, 70 bp, Artificial Sequence
  Synthetic
gccaagcatttaggtgacactataggggagaggaggaataaacaggtttcagagctatgctggaaacagc

SEQ ID NO: 66922 - DNA, 70 bp, Artificial Sequence
  Synthetic
gccaagcatttaggtgacactataggcatggaagcgatgtcatccgtttcagagctatgctggaaacagc

SEQ ID NO: 66923 - DNA, 70 bp, Artificial Sequence
  Synthetic
gccaagcatttaggtgacactatagggaaggccatcaatgcctgagtttcagagctatgctggaaacagc

SEQ ID NO: 66924 - DNA, 70 bp, Artificial Sequence
  Synthetic
gccaagcatttaggtgacactatagtcccttgcccgtgggagtatgtttcagagctatgctggaaacagc

SEQ ID NO: 66925 - DNA, 70 bp, Artificial Sequence
  Synthetic
gccaagcatttaggtgacactatagtccatgaccaggggcaaaatgtttcagagctatgctggaaacagc

SEQ ID NO: 66926 - DNA, 70 bp, Artificial Sequence
  Synthetic
gccaagcatttaggtgacactatagatctcaagtagaaggtcatcgtttcagagctatgctggaaacagc

SEQ ID NO: 66927 - DNA, 70 bp, Artificial Sequence
  Synthetic
gccaagcatttaggtgacactatagagtgctgggctcagaaatacgtttcagagctatgctggaaacagc

SEQ ID NO: 66928 - DNA, 70 bp, Artificial Sequence
  Synthetic
gccaagcatttaggtgacactatagctcaggccccaggttattacgtttcagagctatgctggaaacagc

SEQ ID NO: 66929 - DNA, 70 bp, Artificial Sequence
  Synthetic
gccaagcatttaggtgacactatagaggcctgactcacggcttttgtttcagagctatgctggaaacagc

SEQ ID NO: 66930 - DNA, 70 bp, Artificial Sequence
  Synthetic
gccaagcatttaggtgacactatagcccctggtctgcaaggtgaagtttcagagctatgctggaaacagc

SEQ ID NO: 66931 - DNA, 70 bp, Artificial Sequence
  Synthetic
gccaagcatttaggtgacactatagccttccccgcccctgactgagtttcagagctatgctggaaacagc

SEQ ID NO: 66932 - DNA, 70 bp, Artificial Sequence
  Synthetic
gccaagcatttaggtgacactatagggatcaggttttccgtagttgtttcagagctatgctggaaacagc

SEQ ID NO: 66933 - DNA, 70 bp, Artificial Sequence
  Synthetic
gccaagcatttaggtgacactataggaaatcacgagcttcctaaggtttcagagctatgctggaaacagc

SEQ ID NO: 66934 - DNA, 70 bp, Artificial Sequence
  Synthetic
gccaagcatttaggtgacactatagctattggactaccgtgaggagtttcagagctatgctggaaacagc

SEQ ID NO: 66935 - DNA, 70 bp, Artificial Sequence
  Synthetic
gccaagcatttaggtgacactatagtggggaatacatctttagccgtttcagagctatgctggaaacagc

SEQ ID NO: 66936 - DNA, 70 bp, Artificial Sequence
  Synthetic
gccaagcatttaggtgacactatagaagggggagctatacttaatgtttcagagctatgctggaaacagc

SEQ ID NO: 66937 - DNA, 70 bp, Artificial Sequence
  Synthetic
gccaagcatttaggtgacactatagtttgctgtggagatacttttgtttcagagctatgctggaaacagc

SEQ ID NO: 66938 - DNA, 70 bp, Artificial Sequence
  Synthetic
gccaagcatttaggtgacactatagctcacagctgagtttagcaggtttcagagctatgctggaaacagc

SEQ ID NO: 66939 - DNA, 70 bp, Artificial Sequence
  Synthetic
gccaagcatttaggtgacactatagatgatagaggatatgatcgtgtttcagagctatgctggaaacagc

SEQ ID NO: 66940 - DNA, 70 bp, Artificial Sequence
  Synthetic
gccaagcatttaggtgacactatagaggtgagtatgatcgagatcgtttcagagctatgctggaaacagc

SEQ ID NO: 66941 - DNA, 70 bp, Artificial Sequence
  Synthetic
gccaagcatttaggtgacactataggaccgaggcccggcacaagtgtttcagagctatgctggaaacagc

SEQ ID NO: 66942 - DNA, 70 bp, Artificial Sequence
  Synthetic
gccaagcatttaggtgacactatagtgcagagggtgaccgaggccgtttcagagctatgctggaaacagc

SEQ ID NO: 66943 - DNA, 70 bp, Artificial Sequence
  Synthetic
gccaagcatttaggtgacactatagaaaggcttcttctttgccttgtttcagagctatgctggaaacagc

SEQ ID NO: 66944 - DNA, 70 bp, Artificial Sequence
  Synthetic
gccaagcatttaggtgacactatagctggtgcttccagtcgttacgtttcagagctatgctggaaacagc

SEQ ID NO: 66945 - DNA, 70 bp, Artificial Sequence
  Synthetic
gccaagcatttaggtgacactatagttggggtggccgaggtcagggtttcagagctatgctggaaacagc

SEQ ID NO: 66946 - DNA, 70 bp, Artificial Sequence
  Synthetic
gccaagcatttaggtgacactatagctgcacccctggtctaggccgtttcagagctatgctggaaacagc

SEQ ID NO: 66947 - DNA, 70 bp, Artificial Sequence
  Synthetic
gccaagcatttaggtgacactataggtggagaccagcacttaggggtttcagagctatgctggaaacagc

SEQ ID NO: 66948 - DNA, 70 bp, Artificial Sequence
  Synthetic
gccaagcatttaggtgacactatagggggcagttagagccctgtcgtttcagagctatgctggaaacagc

SEQ ID NO: 66949 - DNA, 70 bp, Artificial Sequence
  Synthetic
gccaagcatttaggtgacactatagcccagctacttatcagggatgtttcagagctatgctggaaacagc

SEQ ID NO: 66950 - DNA, 70 bp, Artificial Sequence
  Synthetic
gccaagcatttaggtgacactatagttcttcattcttgaggatgtgtttcagagctatgctggaaacagc

SEQ ID NO: 66951 - DNA, 70 bp, Artificial Sequence
  Synthetic
gccaagcatttaggtgacactatagtggggatgaacggtgtcacagtttcagagctatgctggaaacagc

SEQ ID NO: 66952 - DNA, 70 bp, Artificial Sequence
  Synthetic
gccaagcatttaggtgacactatagatccttacagcttcaagaacgtttcagagctatgctggaaacagc

SEQ ID NO: 66953 - DNA, 70 bp, Artificial Sequence
  Synthetic
gccaagcatttaggtgacactatagtcaggttgtctttattggccgtttcagagctatgctggaaacagc

SEQ ID NO: 66954 - DNA, 70 bp, Artificial Sequence
  Synthetic
gccaagcatttaggtgacactatagaccccacctgcactcagctggtttcagagctatgctggaaacagc

SEQ ID NO: 66955 - DNA, 70 bp, Artificial Sequence
  Synthetic
gccaagcatttaggtgacactatagacagtgactagagatcctccgtttcagagctatgctggaaacagc

SEQ ID NO: 66956 - DNA, 70 bp, Artificial Sequence
  Synthetic
gccaagcatttaggtgacactataggccacgaagtactgatgcaggtttcagagctatgctggaaacagc

SEQ ID NO: 66957 - DNA, 70 bp, Artificial Sequence
  Synthetic
gccaagcatttaggtgacactatagggctgtggatagcactgtgagtttcagagctatgctggaaacagc

SEQ ID NO: 66958 - DNA, 70 bp, Artificial Sequence
  Synthetic
gccaagcatttaggtgacactatagaagaggaagaggaggagtaagtttcagagctatgctggaaacagc

SEQ ID NO: 66959 - DNA, 70 bp, Artificial Sequence
  Synthetic
gccaagcatttaggtgacactatagctcactgttctcacgaccacgtttcagagctatgctggaaacagc

SEQ ID NO: 66960 - DNA, 70 bp, Artificial Sequence
  Synthetic
gccaagcatttaggtgacactatagaggctgagcaccaccctcaggtttcagagctatgctggaaacagc

SEQ ID NO: 66961 - DNA, 70 bp, Artificial Sequence
  Synthetic
gccaagcatttaggtgacactatagaaacaaactagcttacggtggtttcagagctatgctggaaacagc

SEQ ID NO: 66962 - DNA, 70 bp, Artificial Sequence
  Synthetic
gccaagcatttaggtgacactatagtagcttccgctcgtctgtgtgtttcagagctatgctggaaacagc

SEQ ID NO: 66963 - DNA, 70 bp, Artificial Sequence
  Synthetic
gccaagcatttaggtgacactatagttgagctgagaggagatatagtttcagagctatgctggaaacagc

SEQ ID NO: 66964 - DNA, 70 bp, Artificial Sequence
  Synthetic
gccaagcatttaggtgacactatagggtgtcctgaaggaggactggtttcagagctatgctggaaacagc

SEQ ID NO: 66965 - DNA, 70 bp, Artificial Sequence
  Synthetic
gccaagcatttaggtgacactatagcaaatgtagcagactctcccgtttcagagctatgctggaaacagc

SEQ ID NO: 66966 - DNA, 70 bp, Artificial Sequence
  Synthetic
gccaagcatttaggtgacactataggagtagactgtccgccaaaggtttcagagctatgctggaaacagc

SEQ ID NO: 66967 - DNA, 70 bp, Artificial Sequence
  Synthetic
gccaagcatttaggtgacactatagaagaaactcaagtctccctagtttcagagctatgctggaaacagc

SEQ ID NO: 66968 - DNA, 70 bp, Artificial Sequence
  Synthetic
gccaagcatttaggtgacactatagagaaggcgttctcggaaatggtttcagagctatgctggaaacagc

SEQ ID NO: 66969 - DNA, 70 bp, Artificial Sequence
  Synthetic
gccaagcatttaggtgacactatagctggctgtcagtgtcgctccgtttcagagctatgctggaaacagc

SEQ ID NO: 66970 - DNA, 70 bp, Artificial Sequence
  Synthetic
gccaagcatttaggtgacactataggtaggttgcttcagccagccgtttcagagctatgctggaaacagc

SEQ ID NO: 66971 - DNA, 70 bp, Artificial Sequence
  Synthetic
gccaagcatttaggtgacactataggtcatgttacactgacttccgtttcagagctatgctggaaacagc

SEQ ID NO: 66972 - DNA, 70 bp, Artificial Sequence
  Synthetic
gccaagcatttaggtgacactatagacatcatgcagcagcaataggtttcagagctatgctggaaacagc

SEQ ID NO: 66973 - DNA, 70 bp, Artificial Sequence
  Synthetic
gccaagcatttaggtgacactatagtcatccatgagtcgaccctggtttcagagctatgctggaaacagc

SEQ ID NO: 66974 - DNA, 70 bp, Artificial Sequence
  Synthetic
gccaagcatttaggtgacactataggaggcagctaggccagcttggtttcagagctatgctggaaacagc

SEQ ID NO: 66975 - DNA, 70 bp, Artificial Sequence
  Synthetic
gccaagcatttaggtgacactatagccattaaagtggaaagctgagtttcagagctatgctggaaacagc

SEQ ID NO: 66976 - DNA, 70 bp, Artificial Sequence
  Synthetic
gccaagcatttaggtgacactatagtcaaatgcacttgatcgaatgtttcagagctatgctggaaacagc

SEQ ID NO: 66977 - DNA, 70 bp, Artificial Sequence
  Synthetic
gccaagcatttaggtgacactatagggtgacgtcgatgatgatacgtttcagagctatgctggaaacagc

SEQ ID NO: 66978 - DNA, 70 bp, Artificial Sequence
  Synthetic
gccaagcatttaggtgacactatagggacaatcttccagctggaggtttcagagctatgctggaaacagc

SEQ ID NO: 66979 - DNA, 70 bp, Artificial Sequence
  Synthetic
gccaagcatttaggtgacactatagggtgacagtgtgacagaaatgtttcagagctatgctggaaacagc

SEQ ID NO: 66980 - DNA, 70 bp, Artificial Sequence
  Synthetic
gccaagcatttaggtgacactatagggagacgggggacttacgaggtttcagagctatgctggaaacagc

SEQ ID NO: 66981 - DNA, 70 bp, Artificial Sequence
  Synthetic
gccaagcatttaggtgacactatagaacttttggacctgggtcatgtttcagagctatgctggaaacagc

SEQ ID NO: 66982 - DNA, 70 bp, Artificial Sequence
  Synthetic
gccaagcatttaggtgacactatagttgtggttctagcagatcctgtttcagagctatgctggaaacagc

SEQ ID NO: 66983 - DNA, 70 bp, Artificial Sequence
  Synthetic
gccaagcatttaggtgacactatagtttatctccggcagggtcaggtttcagagctatgctggaaacagc

SEQ ID NO: 66984 - DNA, 70 bp, Artificial Sequence
  Synthetic
gccaagcatttaggtgacactataggcgaggcaggcttaggatttgtttcagagctatgctggaaacagc

SEQ ID NO: 66985 - DNA, 70 bp, Artificial Sequence
  Synthetic
gccaagcatttaggtgacactatagtgaccacgctctcaatgcccgtttcagagctatgctggaaacagc

SEQ ID NO: 66986 - DNA, 70 bp, Artificial Sequence
  Synthetic
gccaagcatttaggtgacactatagagaggtggcttatcaaacttgtttcagagctatgctggaaacagc

SEQ ID NO: 66987 - DNA, 70 bp, Artificial Sequence
  Synthetic
gccaagcatttaggtgacactatagacacattactgatgatgatcgtttcagagctatgctggaaacagc

SEQ ID NO: 66988 - DNA, 70 bp, Artificial Sequence
  Synthetic
gccaagcatttaggtgacactatagcgtgtgtgccctggaggcgcgtttcagagctatgctggaaacagc

SEQ ID NO: 66989 - DNA, 70 bp, Artificial Sequence
  Synthetic
gccaagcatttaggtgacactataggagagaacctataaactagcgtttcagagctatgctggaaacagc

SEQ ID NO: 66990 - DNA, 70 bp, Artificial Sequence
  Synthetic
gccaagcatttaggtgacactatagcgaactctggaggaaatccagtttcagagctatgctggaaacagc

SEQ ID NO: 66991 - DNA, 70 bp, Artificial Sequence
  Synthetic
gccaagcatttaggtgacactatagcgttgagactatttccaagtgtttcagagctatgctggaaacagc

SEQ ID NO: 66992 - DNA, 70 bp, Artificial Sequence
  Synthetic
gccaagcatttaggtgacactatagacaaccaagacagtggagcagtttcagagctatgctggaaacagc

SEQ ID NO: 66993 - DNA, 70 bp, Artificial Sequence
  Synthetic
gccaagcatttaggtgacactatagccggcatcacctgcccttgagtttcagagctatgctggaaacagc

SEQ ID NO: 66994 - DNA, 70 bp, Artificial Sequence
  Synthetic
gccaagcatttaggtgacactatagcggaggttctaagagaatatgtttcagagctatgctggaaacagc

SEQ ID NO: 66995 - DNA, 70 bp, Artificial Sequence
  Synthetic
gccaagcatttaggtgacactatagggtgacgaagatactgataagtttcagagctatgctggaaacagc

SEQ ID NO: 66996 - DNA, 70 bp, Artificial Sequence
  Synthetic
gccaagcatttaggtgacactatagtctccaggacagaagcaacagtttcagagctatgctggaaacagc

SEQ ID NO: 66997 - DNA, 70 bp, Artificial Sequence
  Synthetic
gccaagcatttaggtgacactatagggagaggagggctgtcaccagtttcagagctatgctggaaacagc

SEQ ID NO: 66998 - DNA, 70 bp, Artificial Sequence
  Synthetic
gccaagcatttaggtgacactatagattgtcattctcctggctgggtttcagagctatgctggaaacagc

SEQ ID NO: 66999 - DNA, 70 bp, Artificial Sequence
  Synthetic
gccaagcatttaggtgacactataggctgaggtcatttgtaccctgtttcagagctatgctggaaacagc

SEQ ID NO: 67000 - DNA, 70 bp, Artificial Sequence
  Synthetic
gccaagcatttaggtgacactatagttcccagtctgtgtgctgaggtttcagagctatgctggaaacagc

SEQ ID NO: 67001 - DNA, 70 bp, Artificial Sequence
  Synthetic
gccaagcatttaggtgacactatagcagggctgagagacacgtgagtttcagagctatgctggaaacagc

SEQ ID NO: 67002 - DNA, 70 bp, Artificial Sequence
  Synthetic
gccaagcatttaggtgacactatagtggaagcagggactggttgagtttcagagctatgctggaaacagc

SEQ ID NO: 67003 - DNA, 70 bp, Artificial Sequence
  Synthetic
gccaagcatttaggtgacactatagagtgtgatgagcagcttagcgtttcagagctatgctggaaacagc

SEQ ID NO: 67004 - DNA, 70 bp, Artificial Sequence
  Synthetic
gccaagcatttaggtgacactatagccggtccagagtcactgacggtttcagagctatgctggaaacagc

SEQ ID NO: 67005 - DNA, 70 bp, Artificial Sequence
  Synthetic
gccaagcatttaggtgacactataggtggaagtctacttgatctggtttcagagctatgctggaaacagc

SEQ ID NO: 67006 - DNA, 70 bp, Artificial Sequence
  Synthetic
gccaagcatttaggtgacactatagctaacaggactcacaacatcgtttcagagctatgctggaaacagc

SEQ ID NO: 67007 - DNA, 70 bp, Artificial Sequence
  Synthetic
gccaagcatttaggtgacactatagcaagattcagtcttgcttcagtttcagagctatgctggaaacagc

SEQ ID NO: 67008 - DNA, 70 bp, Artificial Sequence
  Synthetic
gccaagcatttaggtgacactatagcctggccacacctggggagtgtttcagagctatgctggaaacagc

SEQ ID NO: 67009 - DNA, 70 bp, Artificial Sequence
  Synthetic
gccaagcatttaggtgacactataggcctgatgaccccagcctgggtttcagagctatgctggaaacagc

SEQ ID NO: 67010 - DNA, 70 bp, Artificial Sequence
  Synthetic
gccaagcatttaggtgacactatagaaaactgggttcactcctccgtttcagagctatgctggaaacagc

SEQ ID NO: 67011 - DNA, 70 bp, Artificial Sequence
  Synthetic
gccaagcatttaggtgacactataggacgagcttttccaatggttgtttcagagctatgctggaaacagc

SEQ ID NO: 67012 - DNA, 70 bp, Artificial Sequence
  Synthetic
gccaagcatttaggtgacactatagtgacacctgcttggcttctggtttcagagctatgctggaaacagc

SEQ ID NO: 67013 - DNA, 70 bp, Artificial Sequence
  Synthetic
gccaagcatttaggtgacactatagtttcaggcttttctttgccagtttcagagctatgctggaaacagc

SEQ ID NO: 67014 - DNA, 70 bp, Artificial Sequence
  Synthetic
gccaagcatttaggtgacactatagttttggggattagcagaagagtttcagagctatgctggaaacagc

SEQ ID NO: 67015 - DNA, 70 bp, Artificial Sequence
  Synthetic
gccaagcatttaggtgacactataggcatgagctcagttaaagaagtttcagagctatgctggaaacagc

SEQ ID NO: 67016 - DNA, 70 bp, Artificial Sequence
  Synthetic
gccaagcatttaggtgacactatagagaagtggttctgtatggctgtttcagagctatgctggaaacagc

SEQ ID NO: 67017 - DNA, 70 bp, Artificial Sequence
  Synthetic
gccaagcatttaggtgacactatagctatatgccctggacctagtgtttcagagctatgctggaaacagc

SEQ ID NO: 67018 - DNA, 70 bp, Artificial Sequence
  Synthetic
gccaagcatttaggtgacactatagacagaagtagctgcatagaagtttcagagctatgctggaaacagc

SEQ ID NO: 67019 - DNA, 70 bp, Artificial Sequence
  Synthetic
gccaagcatttaggtgacactatagttctccctgagctcctgagagtttcagagctatgctggaaacagc

SEQ ID NO: 67020 - DNA, 70 bp, Artificial Sequence
  Synthetic
gccaagcatttaggtgacactatagaccctggctccccagtgactgtttcagagctatgctggaaacagc

SEQ ID NO: 67021 - DNA, 70 bp, Artificial Sequence
  Synthetic
gccaagcatttaggtgacactatagtttggtggtactgaacaatggtttcagagctatgctggaaacagc

SEQ ID NO: 67022 - DNA, 70 bp, Artificial Sequence
  Synthetic
gccaagcatttaggtgacactataggcatcccccggctgccctaggtttcagagctatgctggaaacagc

SEQ ID NO: 67023 - DNA, 70 bp, Artificial Sequence
  Synthetic
gccaagcatttaggtgacactatagcttacgctgaaaggctgaaggtttcagagctatgctggaaacagc

SEQ ID NO: 67024 - DNA, 70 bp, Artificial Sequence
  Synthetic
gccaagcatttaggtgacactatagctagggagcagtccccaccagtttcagagctatgctggaaacagc

SEQ ID NO: 67025 - DNA, 70 bp, Artificial Sequence
  Synthetic
gccaagcatttaggtgacactatagtttgcaggtcaggccaacatgtttcagagctatgctggaaacagc

SEQ ID NO: 67026 - DNA, 70 bp, Artificial Sequence
  Synthetic
gccaagcatttaggtgacactataggccgaggcgggcagatcacggtttcagagctatgctggaaacagc

SEQ ID NO: 67027 - DNA, 70 bp, Artificial Sequence
  Synthetic
gccaagcatttaggtgacactatagacagtgaccatgtgggtgaagtttcagagctatgctggaaacagc

SEQ ID NO: 67028 - DNA, 70 bp, Artificial Sequence
  Synthetic
gccaagcatttaggtgacactatagttcactgtgccttcgtaggggtttcagagctatgctggaaacagc

SEQ ID NO: 67029 - DNA, 70 bp, Artificial Sequence
  Synthetic
gccaagcatttaggtgacactatagcatgttgtggttgcagactcgtttcagagctatgctggaaacagc

SEQ ID NO: 67030 - DNA, 70 bp, Artificial Sequence
  Synthetic
gccaagcatttaggtgacactatagggccacagtagtcatgctccgtttcagagctatgctggaaacagc

SEQ ID NO: 67031 - DNA, 70 bp, Artificial Sequence
  Synthetic
gccaagcatttaggtgacactatagaaggatccactgactattgagtttcagagctatgctggaaacagc

SEQ ID NO: 67032 - DNA, 70 bp, Artificial Sequence
  Synthetic
gccaagcatttaggtgacactatagaatgagaacactcaggagctgtttcagagctatgctggaaacagc

SEQ ID NO: 67033 - DNA, 70 bp, Artificial Sequence
  Synthetic
gccaagcatttaggtgacactatagaagaggtagtcacagagaaagtttcagagctatgctggaaacagc

SEQ ID NO: 67034 - DNA, 70 bp, Artificial Sequence
  Synthetic
gccaagcatttaggtgacactatagacttgtagctgctggagtatgtttcagagctatgctggaaacagc

SEQ ID NO: 67035 - DNA, 70 bp, Artificial Sequence
  Synthetic
gccaagcatttaggtgacactatagagtctccataaattatgctggtttcagagctatgctggaaacagc

SEQ ID NO: 67036 - DNA, 70 bp, Artificial Sequence
  Synthetic
gccaagcatttaggtgacactatagggcgttcttcaatgcttttggtttcagagctatgctggaaacagc

SEQ ID NO: 67037 - DNA, 70 bp, Artificial Sequence
  Synthetic
gccaagcatttaggtgacactatagatctgctcccccaagtaggcgtttcagagctatgctggaaacagc

SEQ ID NO: 67038 - DNA, 70 bp, Artificial Sequence
  Synthetic
gccaagcatttaggtgacactatagtcagggctcagggtcttagcgtttcagagctatgctggaaacagc

SEQ ID NO: 67039 - DNA, 70 bp, Artificial Sequence
  Synthetic
gccaagcatttaggtgacactatagatggagacctccccttgagggtttcagagctatgctggaaacagc

SEQ ID NO: 67040 - DNA, 70 bp, Artificial Sequence
  Synthetic
gccaagcatttaggtgacactatagcatgggggctccagcctcaggtttcagagctatgctggaaacagc

SEQ ID NO: 67041 - DNA, 70 bp, Artificial Sequence
  Synthetic
gccaagcatttaggtgacactatagtccttccgccaggagctcatgtttcagagctatgctggaaacagc

SEQ ID NO: 67042 - DNA, 70 bp, Artificial Sequence
  Synthetic
gccaagcatttaggtgacactatagcagggcctctgtacagctacgtttcagagctatgctggaaacagc

SEQ ID NO: 67043 - DNA, 70 bp, Artificial Sequence
  Synthetic
gccaagcatttaggtgacactatagtctgagctggcttagcttgagtttcagagctatgctggaaacagc

SEQ ID NO: 67044 - DNA, 70 bp, Artificial Sequence
  Synthetic
gccaagcatttaggtgacactatagataatttctcatcccctatggtttcagagctatgctggaaacagc

SEQ ID NO: 67045 - DNA, 70 bp, Artificial Sequence
  Synthetic
gccaagcatttaggtgacactatagctggtctctcatctgactttgtttcagagctatgctggaaacagc

SEQ ID NO: 67046 - DNA, 70 bp, Artificial Sequence
  Synthetic
gccaagcatttaggtgacactatagtaactcacaagcaccactccgtttcagagctatgctggaaacagc

SEQ ID NO: 67047 - DNA, 70 bp, Artificial Sequence
  Synthetic
gccaagcatttaggtgacactataggaagaactggatggctgagcgtttcagagctatgctggaaacagc

SEQ ID NO: 67048 - DNA, 70 bp, Artificial Sequence
  Synthetic
gccaagcatttaggtgacactatagggtgttggggtcaaagctgagtttcagagctatgctggaaacagc

SEQ ID NO: 67049 - DNA, 70 bp, Artificial Sequence
  Synthetic
gccaagcatttaggtgacactataggaggccgtgaaaccctcaccgtttcagagctatgctggaaacagc

SEQ ID NO: 67050 - DNA, 70 bp, Artificial Sequence
  Synthetic
gccaagcatttaggtgacactataggtttcaactacatgtcctctgtttcagagctatgctggaaacagc

SEQ ID NO: 67051 - DNA, 70 bp, Artificial Sequence
  Synthetic
gccaagcatttaggtgacactataggtattgaagctgagatcttcgtttcagagctatgctggaaacagc

SEQ ID NO: 67052 - DNA, 70 bp, Artificial Sequence
  Synthetic
gccaagcatttaggtgacactatagctgcctcccccaggtgactagtttcagagctatgctggaaacagc

SEQ ID NO: 67053 - DNA, 70 bp, Artificial Sequence
  Synthetic
gccaagcatttaggtgacactatagcccaacagattgggagtgacgtttcagagctatgctggaaacagc

SEQ ID NO: 67054 - DNA, 70 bp, Artificial Sequence
  Synthetic
gccaagcatttaggtgacactatagccagtgactgataggaaatggtttcagagctatgctggaaacagc

SEQ ID NO: 67055 - DNA, 70 bp, Artificial Sequence
  Synthetic
gccaagcatttaggtgacactatagtgaacaggtcagagcttctggtttcagagctatgctggaaacagc

SEQ ID NO: 67056 - DNA, 70 bp, Artificial Sequence
  Synthetic
gccaagcatttaggtgacactataggcgggtggcaggataatcaagtttcagagctatgctggaaacagc

SEQ ID NO: 67057 - DNA, 70 bp, Artificial Sequence
  Synthetic
gccaagcatttaggtgacactatagtctcaagtgaagctaaattcgtttcagagctatgctggaaacagc

SEQ ID NO: 67058 - DNA, 70 bp, Artificial Sequence
  Synthetic
gccaagcatttaggtgacactatagaaggggctcagaagtgcttcgtttcagagctatgctggaaacagc

SEQ ID NO: 67059 - DNA, 70 bp, Artificial Sequence
  Synthetic
gccaagcatttaggtgacactatagtacactggccacagatgatcgtttcagagctatgctggaaacagc

SEQ ID NO: 67060 - DNA, 70 bp, Artificial Sequence
  Synthetic
gccaagcatttaggtgacactataggtgaagaagaggacacatgagtttcagagctatgctggaaacagc

SEQ ID NO: 67061 - DNA, 70 bp, Artificial Sequence
  Synthetic
gccaagcatttaggtgacactatagtaggactgtggctctctgatgtttcagagctatgctggaaacagc

SEQ ID NO: 67062 - DNA, 70 bp, Artificial Sequence
  Synthetic
gccaagcatttaggtgacactatagctggaaggctcagtccagctgtttcagagctatgctggaaacagc

SEQ ID NO: 67063 - DNA, 70 bp, Artificial Sequence
  Synthetic
gccaagcatttaggtgacactatagtacaattccagctactcggggtttcagagctatgctggaaacagc

SEQ ID NO: 67064 - DNA, 70 bp, Artificial Sequence
  Synthetic
gccaagcatttaggtgacactataggcatatccgtgctgaagagggtttcagagctatgctggaaacagc

SEQ ID NO: 67065 - DNA, 70 bp, Artificial Sequence
  Synthetic
gccaagcatttaggtgacactatagctcagggcagggcccatcacgtttcagagctatgctggaaacagc

SEQ ID NO: 67066 - DNA, 70 bp, Artificial Sequence
  Synthetic
gccaagcatttaggtgacactataggctctttctcacctcctctcgtttcagagctatgctggaaacagc

SEQ ID NO: 67067 - DNA, 70 bp, Artificial Sequence
  Synthetic
gccaagcatttaggtgacactatagtctgatttgtctctggtcaggtttcagagctatgctggaaacagc

SEQ ID NO: 67068 - DNA, 70 bp, Artificial Sequence
  Synthetic
gccaagcatttaggtgacactatagacagatgtccgacgctactggtttcagagctatgctggaaacagc

SEQ ID NO: 67069 - DNA, 70 bp, Artificial Sequence
  Synthetic
gccaagcatttaggtgacactatagggggtaagttatgtgtgtctgtttcagagctatgctggaaacagc

SEQ ID NO: 67070 - DNA, 70 bp, Artificial Sequence
  Synthetic
gccaagcatttaggtgacactatagtgtaagaaggttcaagagctgtttcagagctatgctggaaacagc

SEQ ID NO: 67071 - DNA, 70 bp, Artificial Sequence
  Synthetic
gccaagcatttaggtgacactataggagcagcccaccaagctgtagtttcagagctatgctggaaacagc

SEQ ID NO: 67072 - DNA, 70 bp, Artificial Sequence
  Synthetic
gccaagcatttaggtgacactatagaagtgactacagcaaaagatgtttcagagctatgctggaaacagc

SEQ ID NO: 67073 - DNA, 70 bp, Artificial Sequence
  Synthetic
gccaagcatttaggtgacactatagggaggtggtgcaggagtaccgtttcagagctatgctggaaacagc

SEQ ID NO: 67074 - DNA, 70 bp, Artificial Sequence
  Synthetic
gccaagcatttaggtgacactatagagctcgcaagaggctgaggcgtttcagagctatgctggaaacagc

SEQ ID NO: 67075 - DNA, 70 bp, Artificial Sequence
  Synthetic
gccaagcatttaggtgacactataggcaagaaagcattcacagcagtttcagagctatgctggaaacagc

SEQ ID NO: 67076 - DNA, 70 bp, Artificial Sequence
  Synthetic
gccaagcatttaggtgacactataggcctttggaggaggtggtgcgtttcagagctatgctggaaacagc

SEQ ID NO: 67077 - DNA, 70 bp, Artificial Sequence
  Synthetic
gccaagcatttaggtgacactatagtcaagacgaactctaactcagtttcagagctatgctggaaacagc

SEQ ID NO: 67078 - DNA, 70 bp, Artificial Sequence
  Synthetic
gccaagcatttaggtgacactataggagcggccggatgggccttagtttcagagctatgctggaaacagc

SEQ ID NO: 67079 - DNA, 70 bp, Artificial Sequence
  Synthetic
gccaagcatttaggtgacactatagagtaatctgcctagcgctttgtttcagagctatgctggaaacagc

SEQ ID NO: 67080 - DNA, 70 bp, Artificial Sequence
  Synthetic
gccaagcatttaggtgacactatagttcatttagggagttcaaccgtttcagagctatgctggaaacagc

SEQ ID NO: 67081 - DNA, 70 bp, Artificial Sequence
  Synthetic
gccaagcatttaggtgacactatagcgttctccggacagttaaaggtttcagagctatgctggaaacagc

SEQ ID NO: 67082 - DNA, 70 bp, Artificial Sequence
  Synthetic
gccaagcatttaggtgacactatagtcatctcttacatcagaagcgtttcagagctatgctggaaacagc

SEQ ID NO: 67083 - DNA, 70 bp, Artificial Sequence
  Synthetic
gccaagcatttaggtgacactatagactttggtaaacagatagaggtttcagagctatgctggaaacagc

SEQ ID NO: 67084 - DNA, 70 bp, Artificial Sequence
  Synthetic
gccaagcatttaggtgacactatagttcaagagcttggacgacgcgtttcagagctatgctggaaacagc

SEQ ID NO: 67085 - DNA, 70 bp, Artificial Sequence
  Synthetic
gccaagcatttaggtgacactataggagaaaattcaagagcttgggtttcagagctatgctggaaacagc

SEQ ID NO: 67086 - DNA, 70 bp, Artificial Sequence
  Synthetic
gccaagcatttaggtgacactatagtgagcagattttaagaggttgtttcagagctatgctggaaacagc

SEQ ID NO: 67087 - DNA, 70 bp, Artificial Sequence
  Synthetic
gccaagcatttaggtgacactatagcccagctactcaggagccaggtttcagagctatgctggaaacagc

SEQ ID NO: 67088 - DNA, 70 bp, Artificial Sequence
  Synthetic
gccaagcatttaggtgacactatagccttctgcctggactagatggtttcagagctatgctggaaacagc

SEQ ID NO: 67089 - DNA, 70 bp, Artificial Sequence
  Synthetic
gccaagcatttaggtgacactatagtcattcatccagctccttacgtttcagagctatgctggaaacagc

SEQ ID NO: 67090 - DNA, 70 bp, Artificial Sequence
  Synthetic
gccaagcatttaggtgacactatagctgaggcctttcttttgcttgtttcagagctatgctggaaacagc

SEQ ID NO: 67091 - DNA, 70 bp, Artificial Sequence
  Synthetic
gccaagcatttaggtgacactatagttcagctgagcacctcttccgtttcagagctatgctggaaacagc

SEQ ID NO: 67092 - DNA, 70 bp, Artificial Sequence
  Synthetic
gccaagcatttaggtgacactatagcctggccaacagcatctctcgtttcagagctatgctggaaacagc

SEQ ID NO: 67093 - DNA, 70 bp, Artificial Sequence
  Synthetic
gccaagcatttaggtgacactatagctggggcggccaaagctgtcgtttcagagctatgctggaaacagc

SEQ ID NO: 67094 - DNA, 70 bp, Artificial Sequence
  Synthetic
gccaagcatttaggtgacactatagcatctgctccctggatgggggtttcagagctatgctggaaacagc

SEQ ID NO: 67095 - DNA, 70 bp, Artificial Sequence
  Synthetic
gccaagcatttaggtgacactatagtgtggatgtaagatgtgcaagtttcagagctatgctggaaacagc

SEQ ID NO: 67096 - DNA, 70 bp, Artificial Sequence
  Synthetic
gccaagcatttaggtgacactatagccccccgtgggacattacaggtttcagagctatgctggaaacagc

SEQ ID NO: 67097 - DNA, 70 bp, Artificial Sequence
  Synthetic
gccaagcatttaggtgacactatagcttgcgaatctggccttgaggtttcagagctatgctggaaacagc

SEQ ID NO: 67098 - DNA, 70 bp, Artificial Sequence
  Synthetic
gccaagcatttaggtgacactatagggaaatgcaattagaagacggtttcagagctatgctggaaacagc

SEQ ID NO: 67099 - DNA, 70 bp, Artificial Sequence
  Synthetic
gccaagcatttaggtgacactatagccgtccggcggctcaggcctgtttcagagctatgctggaaacagc

SEQ ID NO: 67100 - DNA, 70 bp, Artificial Sequence
  Synthetic
gccaagcatttaggtgacactatagctctctccaaggttattaccgtttcagagctatgctggaaacagc

SEQ ID NO: 67101 - DNA, 70 bp, Artificial Sequence
  Synthetic
gccaagcatttaggtgacactatagctcagacctttcatttgccagtttcagagctatgctggaaacagc

SEQ ID NO: 67102 - DNA, 70 bp, Artificial Sequence
  Synthetic
gccaagcatttaggtgacactatagttagctcgtcacgtagtgttgtttcagagctatgctggaaacagc

SEQ ID NO: 67103 - DNA, 70 bp, Artificial Sequence
  Synthetic
gccaagcatttaggtgacactatagagcagagcatcaatagcctagtttcagagctatgctggaaacagc

SEQ ID NO: 67104 - DNA, 70 bp, Artificial Sequence
  Synthetic
gccaagcatttaggtgacactataggaactgcgtggcatctaaaggtttcagagctatgctggaaacagc

SEQ ID NO: 67105 - DNA, 70 bp, Artificial Sequence
  Synthetic
gccaagcatttaggtgacactatagactgaacagccacgtctgaggtttcagagctatgctggaaacagc

SEQ ID NO: 67106 - DNA, 70 bp, Artificial Sequence
  Synthetic
gccaagcatttaggtgacactatagctaacagtagcatcacaagagtttcagagctatgctggaaacagc

SEQ ID NO: 67107 - DNA, 70 bp, Artificial Sequence
  Synthetic
gccaagcatttaggtgacactatagttctggataggtcaaactctgtttcagagctatgctggaaacagc

SEQ ID NO: 67108 - DNA, 70 bp, Artificial Sequence
  Synthetic
gccaagcatttaggtgacactatagcgcctgcaggtctcaaaggtgtttcagagctatgctggaaacagc

SEQ ID NO: 67109 - DNA, 70 bp, Artificial Sequence
  Synthetic
gccaagcatttaggtgacactataggcaacagcctggctgagtaggtttcagagctatgctggaaacagc

SEQ ID NO: 67110 - DNA, 70 bp, Artificial Sequence
  Synthetic
gccaagcatttaggtgacactataggagggggcagcaggttacacgtttcagagctatgctggaaacagc

SEQ ID NO: 67111 - DNA, 70 bp, Artificial Sequence
  Synthetic
gccaagcatttaggtgacactataggggttcaattgagcgtgactgtttcagagctatgctggaaacagc

SEQ ID NO: 67112 - DNA, 70 bp, Artificial Sequence
  Synthetic
gccaagcatttaggtgacactataggttacctgacaacagtgctggtttcagagctatgctggaaacagc

SEQ ID NO: 67113 - DNA, 70 bp, Artificial Sequence
  Synthetic
gccaagcatttaggtgacactatagccaaggagctgcaggtagatgtttcagagctatgctggaaacagc

SEQ ID NO: 67114 - DNA, 70 bp, Artificial Sequence
  Synthetic
gccaagcatttaggtgacactatagcttgctatgatcaggaaagagtttcagagctatgctggaaacagc

SEQ ID NO: 67115 - DNA, 70 bp, Artificial Sequence
  Synthetic
gccaagcatttaggtgacactatagccaggccctgtctctggcaggtttcagagctatgctggaaacagc

SEQ ID NO: 67116 - DNA, 70 bp, Artificial Sequence
  Synthetic
gccaagcatttaggtgacactatagtcaagacagcattgaccacggtttcagagctatgctggaaacagc

SEQ ID NO: 67117 - DNA, 70 bp, Artificial Sequence
  Synthetic
gccaagcatttaggtgacactatagtccatcaaggagcaaagaaggtttcagagctatgctggaaacagc

SEQ ID NO: 67118 - DNA, 70 bp, Artificial Sequence
  Synthetic
gccaagcatttaggtgacactatagtaggaagactcagcagtcaggtttcagagctatgctggaaacagc

SEQ ID NO: 67119 - DNA, 70 bp, Artificial Sequence
  Synthetic
gccaagcatttaggtgacactatagtgcttagctaatcttcatctgtttcagagctatgctggaaacagc

SEQ ID NO: 67120 - DNA, 70 bp, Artificial Sequence
  Synthetic
gccaagcatttaggtgacactataggaagcagaagacggaggatggtttcagagctatgctggaaacagc

SEQ ID NO: 67121 - DNA, 70 bp, Artificial Sequence
  Synthetic
gccaagcatttaggtgacactataggggaggggcgtcatttcaccgtttcagagctatgctggaaacagc

SEQ ID NO: 67122 - DNA, 70 bp, Artificial Sequence
  Synthetic
gccaagcatttaggtgacactatagagctcttgatcattctgcccgtttcagagctatgctggaaacagc

SEQ ID NO: 67123 - DNA, 70 bp, Artificial Sequence
  Synthetic
gccaagcatttaggtgacactatagttggtgtctctagggtcttagtttcagagctatgctggaaacagc

SEQ ID NO: 67124 - DNA, 70 bp, Artificial Sequence
  Synthetic
gccaagcatttaggtgacactatagttattggttcagtctatgccgtttcagagctatgctggaaacagc

SEQ ID NO: 67125 - DNA, 70 bp, Artificial Sequence
  Synthetic
gccaagcatttaggtgacactataggaaaccaggtaacattagtggtttcagagctatgctggaaacagc

SEQ ID NO: 67126 - DNA, 70 bp, Artificial Sequence
  Synthetic
gccaagcatttaggtgacactatagtcggaactcagtggaatgatgtttcagagctatgctggaaacagc

SEQ ID NO: 67127 - DNA, 70 bp, Artificial Sequence
  Synthetic
gccaagcatttaggtgacactataggttcccaagagaaaacatacgtttcagagctatgctggaaacagc

SEQ ID NO: 67128 - DNA, 70 bp, Artificial Sequence
  Synthetic
gccaagcatttaggtgacactatagactgtttactgctggaagaagtttcagagctatgctggaaacagc

SEQ ID NO: 67129 - DNA, 70 bp, Artificial Sequence
  Synthetic
gccaagcatttaggtgacactatagtcatcaccttcatgttgagcgtttcagagctatgctggaaacagc

SEQ ID NO: 67130 - DNA, 70 bp, Artificial Sequence
  Synthetic
gccaagcatttaggtgacactatagtcattcattatggctaaccagtttcagagctatgctggaaacagc

SEQ ID NO: 67131 - DNA, 70 bp, Artificial Sequence
  Synthetic
gccaagcatttaggtgacactatagtcttaattttcattcctggggtttcagagctatgctggaaacagc

SEQ ID NO: 67132 - DNA, 70 bp, Artificial Sequence
  Synthetic
gccaagcatttaggtgacactatagcaacatgctgctgagtgaaggtttcagagctatgctggaaacagc

SEQ ID NO: 67133 - DNA, 70 bp, Artificial Sequence
  Synthetic
gccaagcatttaggtgacactataggagcactggcagcctcagtggtttcagagctatgctggaaacagc

SEQ ID NO: 67134 - DNA, 70 bp, Artificial Sequence
  Synthetic
gccaagcatttaggtgacactatagcctgtccttcagttggctaggtttcagagctatgctggaaacagc

SEQ ID NO: 67135 - DNA, 70 bp, Artificial Sequence
  Synthetic
gccaagcatttaggtgacactatagcaccagaaacaactgcttaagtttcagagctatgctggaaacagc

SEQ ID NO: 67136 - DNA, 70 bp, Artificial Sequence
  Synthetic
gccaagcatttaggtgacactatagaagcaagtggctgcagaagagtttcagagctatgctggaaacagc

SEQ ID NO: 67137 - DNA, 70 bp, Artificial Sequence
  Synthetic
gccaagcatttaggtgacactatagctgcagagccccatctaaccgtttcagagctatgctggaaacagc

SEQ ID NO: 67138 - DNA, 70 bp, Artificial Sequence
  Synthetic
gccaagcatttaggtgacactatagtgggaccttcccctcatcctgtttcagagctatgctggaaacagc

SEQ ID NO: 67139 - DNA, 70 bp, Artificial Sequence
  Synthetic
gccaagcatttaggtgacactatagaggctgcttatcgagtaaaggtttcagagctatgctggaaacagc

SEQ ID NO: 67140 - DNA, 70 bp, Artificial Sequence
  Synthetic
gccaagcatttaggtgacactataggctcatgaaatcttcttcctgtttcagagctatgctggaaacagc

SEQ ID NO: 67141 - DNA, 70 bp, Artificial Sequence
  Synthetic
gccaagcatttaggtgacactatagacctcttaaaaggcagaggagtttcagagctatgctggaaacagc

SEQ ID NO: 67142 - DNA, 70 bp, Artificial Sequence
  Synthetic
gccaagcatttaggtgacactatagaagggttaagagtcagactcgtttcagagctatgctggaaacagc

SEQ ID NO: 67143 - DNA, 70 bp, Artificial Sequence
  Synthetic
gccaagcatttaggtgacactatagcaccaagaccccaggctagggtttcagagctatgctggaaacagc

SEQ ID NO: 67144 - DNA, 70 bp, Artificial Sequence
  Synthetic
gccaagcatttaggtgacactatagtggagtactcagttaagttggtttcagagctatgctggaaacagc

SEQ ID NO: 67145 - DNA, 70 bp, Artificial Sequence
  Synthetic
gccaagcatttaggtgacactataggatccatctctgtcagagcagtttcagagctatgctggaaacagc

SEQ ID NO: 67146 - DNA, 70 bp, Artificial Sequence
  Synthetic
gccaagcatttaggtgacactataggctgtcactggggctctcaggtttcagagctatgctggaaacagc

SEQ ID NO: 67147 - DNA, 70 bp, Artificial Sequence
  Synthetic
gccaagcatttaggtgacactatagatccctgccatgatgtagccgtttcagagctatgctggaaacagc

SEQ ID NO: 67148 - DNA, 70 bp, Artificial Sequence
  Synthetic
gccaagcatttaggtgacactataggggcgtggaggtcagcgctggtttcagagctatgctggaaacagc

SEQ ID NO: 67149 - DNA, 70 bp, Artificial Sequence
  Synthetic
gccaagcatttaggtgacactatagcgagaacagtggaaaaaaaggtttcagagctatgctggaaacagc

SEQ ID NO: 67150 - DNA, 70 bp, Artificial Sequence
  Synthetic
gccaagcatttaggtgacactatagcagctgagggtgtcatgtgagtttcagagctatgctggaaacagc

SEQ ID NO: 67151 - DNA, 70 bp, Artificial Sequence
  Synthetic
gccaagcatttaggtgacactatagggcttctcgtatggctagtggtttcagagctatgctggaaacagc

SEQ ID NO: 67152 - DNA, 70 bp, Artificial Sequence
  Synthetic
gccaagcatttaggtgacactataggtgattacaggtacaagccagtttcagagctatgctggaaacagc

SEQ ID NO: 67153 - DNA, 70 bp, Artificial Sequence
  Synthetic
gccaagcatttaggtgacactatagtgtctcatcatggagagcccgtttcagagctatgctggaaacagc

SEQ ID NO: 67154 - DNA, 70 bp, Artificial Sequence
  Synthetic
gccaagcatttaggtgacactatagcggctttgatactggagctcgtttcagagctatgctggaaacagc

SEQ ID NO: 67155 - DNA, 70 bp, Artificial Sequence
  Synthetic
gccaagcatttaggtgacactatagtctatcatctgggtctgcaagtttcagagctatgctggaaacagc

SEQ ID NO: 67156 - DNA, 70 bp, Artificial Sequence
  Synthetic
gccaagcatttaggtgacactatagtgaggagctaaggctcaagagtttcagagctatgctggaaacagc

SEQ ID NO: 67157 - DNA, 70 bp, Artificial Sequence
  Synthetic
gccaagcatttaggtgacactatagtaagggatttacttggctttgtttcagagctatgctggaaacagc

SEQ ID NO: 67158 - DNA, 70 bp, Artificial Sequence
  Synthetic
gccaagcatttaggtgacactatagtcattcacatctcagcatgcgtttcagagctatgctggaaacagc

SEQ ID NO: 67159 - DNA, 70 bp, Artificial Sequence
  Synthetic
gccaagcatttaggtgacactatagttgtggtcacgtaatcttcggtttcagagctatgctggaaacagc

SEQ ID NO: 67160 - DNA, 70 bp, Artificial Sequence
  Synthetic
gccaagcatttaggtgacactatagcatagacagggacttcactggtttcagagctatgctggaaacagc

SEQ ID NO: 67161 - DNA, 70 bp, Artificial Sequence
  Synthetic
gccaagcatttaggtgacactatagatgattagggcttgacttaggtttcagagctatgctggaaacagc

SEQ ID NO: 67162 - DNA, 70 bp, Artificial Sequence
  Synthetic
gccaagcatttaggtgacactatagagatcaggctatgttagacagtttcagagctatgctggaaacagc

SEQ ID NO: 67163 - DNA, 70 bp, Artificial Sequence
  Synthetic
gccaagcatttaggtgacactatagatccatggaaccaaatcaaggtttcagagctatgctggaaacagc

SEQ ID NO: 67164 - DNA, 70 bp, Artificial Sequence
  Synthetic
gccaagcatttaggtgacactataggaccacctgagggtgaacaagtttcagagctatgctggaaacagc

SEQ ID NO: 67165 - DNA, 70 bp, Artificial Sequence
  Synthetic
gccaagcatttaggtgacactatagacactagatgttctttacaggtttcagagctatgctggaaacagc

SEQ ID NO: 67166 - DNA, 70 bp, Artificial Sequence
  Synthetic
gccaagcatttaggtgacactatagagactagcattcagtttctggtttcagagctatgctggaaacagc

SEQ ID NO: 67167 - DNA, 70 bp, Artificial Sequence
  Synthetic
gccaagcatttaggtgacactataggaaggcagccgctgagttcggtttcagagctatgctggaaacagc

SEQ ID NO: 67168 - DNA, 70 bp, Artificial Sequence
  Synthetic
gccaagcatttaggtgacactatagatactcagaagaaggcgggtgtttcagagctatgctggaaacagc

SEQ ID NO: 67169 - DNA, 70 bp, Artificial Sequence
  Synthetic
gccaagcatttaggtgacactatagtgtgcttgctttcaaagcttgtttcagagctatgctggaaacagc

SEQ ID NO: 67170 - DNA, 70 bp, Artificial Sequence
  Synthetic
gccaagcatttaggtgacactatagcgccaccccctgacctgcctgtttcagagctatgctggaaacagc

SEQ ID NO: 67171 - DNA, 70 bp, Artificial Sequence
  Synthetic
gccaagcatttaggtgacactatagccaagcagctcaggtgtccggtttcagagctatgctggaaacagc

SEQ ID NO: 67172 - DNA, 70 bp, Artificial Sequence
  Synthetic
gccaagcatttaggtgacactatagtagttgcatatcatcttctggtttcagagctatgctggaaacagc

SEQ ID NO: 67173 - DNA, 70 bp, Artificial Sequence
  Synthetic
gccaagcatttaggtgacactatagagttgattctgattctttgggtttcagagctatgctggaaacagc

SEQ ID NO: 67174 - DNA, 70 bp, Artificial Sequence
  Synthetic
gccaagcatttaggtgacactataggaggcatcgatttagacaacgtttcagagctatgctggaaacagc

SEQ ID NO: 67175 - DNA, 70 bp, Artificial Sequence
  Synthetic
gccaagcatttaggtgacactataggcataggaacaatgcacaaggtttcagagctatgctggaaacagc

SEQ ID NO: 67176 - DNA, 70 bp, Artificial Sequence
  Synthetic
gccaagcatttaggtgacactatagacagctccagagaaaggagggtttcagagctatgctggaaacagc

SEQ ID NO: 67177 - DNA, 70 bp, Artificial Sequence
  Synthetic
gccaagcatttaggtgacactataggccgcttccggggagaagtggtttcagagctatgctggaaacagc

SEQ ID NO: 67178 - DNA, 70 bp, Artificial Sequence
  Synthetic
gccaagcatttaggtgacactataggctgcatctgggccatcagtgtttcagagctatgctggaaacagc

SEQ ID NO: 67179 - DNA, 70 bp, Artificial Sequence
  Synthetic
gccaagcatttaggtgacactatagtgggttccgcttctacaccggtttcagagctatgctggaaacagc

SEQ ID NO: 67180 - DNA, 70 bp, Artificial Sequence
  Synthetic
gccaagcatttaggtgacactatagctgggctgcagtccctagaggtttcagagctatgctggaaacagc

SEQ ID NO: 67181 - DNA, 70 bp, Artificial Sequence
  Synthetic
gccaagcatttaggtgacactatagtagtgagggggatggagagggtttcagagctatgctggaaacagc

SEQ ID NO: 67182 - DNA, 70 bp, Artificial Sequence
  Synthetic
gccaagcatttaggtgacactatagtctggaggacggggagagctgtttcagagctatgctggaaacagc

SEQ ID NO: 67183 - DNA, 70 bp, Artificial Sequence
  Synthetic
gccaagcatttaggtgacactatagtggcggccacagtcacagccgtttcagagctatgctggaaacagc

SEQ ID NO: 67184 - DNA, 70 bp, Artificial Sequence
  Synthetic
gccaagcatttaggtgacactatagaaaacctgagtctaatgaacgtttcagagctatgctggaaacagc

SEQ ID NO: 67185 - DNA, 70 bp, Artificial Sequence
  Synthetic
gccaagcatttaggtgacactatagtggggctggagaggggtgcggtttcagagctatgctggaaacagc

SEQ ID NO: 67186 - DNA, 70 bp, Artificial Sequence
  Synthetic
gccaagcatttaggtgacactataggagttattgcttcccctcccgtttcagagctatgctggaaacagc

SEQ ID NO: 67187 - DNA, 70 bp, Artificial Sequence
  Synthetic
gccaagcatttaggtgacactatagttcatttactgaattggggcgtttcagagctatgctggaaacagc

SEQ ID NO: 67188 - DNA, 70 bp, Artificial Sequence
  Synthetic
gccaagcatttaggtgacactatagactcatcatgaacacagctagtttcagagctatgctggaaacagc

SEQ ID NO: 67189 - DNA, 70 bp, Artificial Sequence
  Synthetic
gccaagcatttaggtgacactataggacttcaccgagtttgtgtggtttcagagctatgctggaaacagc

SEQ ID NO: 67190 - DNA, 70 bp, Artificial Sequence
  Synthetic
gccaagcatttaggtgacactatagcgggggcataggcagctatggtttcagagctatgctggaaacagc

SEQ ID NO: 67191 - DNA, 70 bp, Artificial Sequence
  Synthetic
gccaagcatttaggtgacactatagtgtgactgagaaatactctggtttcagagctatgctggaaacagc

SEQ ID NO: 67192 - DNA, 70 bp, Artificial Sequence
  Synthetic
gccaagcatttaggtgacactatagctttatgctgaggagacattgtttcagagctatgctggaaacagc

SEQ ID NO: 67193 - DNA, 70 bp, Artificial Sequence
  Synthetic
gccaagcatttaggtgacactatagtggtggttctgcggtgtaaggtttcagagctatgctggaaacagc

SEQ ID NO: 67194 - DNA, 70 bp, Artificial Sequence
  Synthetic
gccaagcatttaggtgacactatagtaagggaagggaggctcagagtttcagagctatgctggaaacagc

SEQ ID NO: 67195 - DNA, 70 bp, Artificial Sequence
  Synthetic
gccaagcatttaggtgacactatagaaaacaagcatcaggaaacagtttcagagctatgctggaaacagc

SEQ ID NO: 67196 - DNA, 70 bp, Artificial Sequence
  Synthetic
gccaagcatttaggtgacactatagagagaaatattctgagggtcgtttcagagctatgctggaaacagc

SEQ ID NO: 67197 - DNA, 70 bp, Artificial Sequence
  Synthetic
gccaagcatttaggtgacactatagatttatgctgccagaccctcgtttcagagctatgctggaaacagc

SEQ ID NO: 67198 - DNA, 70 bp, Artificial Sequence
  Synthetic
gccaagcatttaggtgacactatagcaggataagggagatcttgagtttcagagctatgctggaaacagc

SEQ ID NO: 67199 - DNA, 70 bp, Artificial Sequence
  Synthetic
gccaagcatttaggtgacactataggagaatcgcttaaacccagcgtttcagagctatgctggaaacagc

SEQ ID NO: 67200 - DNA, 70 bp, Artificial Sequence
  Synthetic
gccaagcatttaggtgacactataggatgggtttcttcacgagaggtttcagagctatgctggaaacagc

SEQ ID NO: 67201 - DNA, 70 bp, Artificial Sequence
  Synthetic
gccaagcatttaggtgacactatagaggtctctggagttcactgcgtttcagagctatgctggaaacagc

SEQ ID NO: 67202 - DNA, 70 bp, Artificial Sequence
  Synthetic
gccaagcatttaggtgacactatagtcaggaggtctcaataaactgtttcagagctatgctggaaacagc

SEQ ID NO: 67203 - DNA, 70 bp, Artificial Sequence
  Synthetic
gccaagcatttaggtgacactatagtcacgttgccccaggatgtggtttcagagctatgctggaaacagc

SEQ ID NO: 67204 - DNA, 70 bp, Artificial Sequence
  Synthetic
gccaagcatttaggtgacactatagaggtgcttagagcagtcaaggtttcagagctatgctggaaacagc

SEQ ID NO: 67205 - DNA, 70 bp, Artificial Sequence
  Synthetic
gccaagcatttaggtgacactatagagaggcagcagaaactgaatgtttcagagctatgctggaaacagc

SEQ ID NO: 67206 - DNA, 70 bp, Artificial Sequence
  Synthetic
gccaagcatttaggtgacactatagatgcagagggttgatcctttgtttcagagctatgctggaaacagc

SEQ ID NO: 67207 - DNA, 70 bp, Artificial Sequence
  Synthetic
gccaagcatttaggtgacactatagggtatcagagaagtcagtaggtttcagagctatgctggaaacagc

SEQ ID NO: 67208 - DNA, 70 bp, Artificial Sequence
  Synthetic
gccaagcatttaggtgacactatagctaatgatcgatctaggcctgtttcagagctatgctggaaacagc

SEQ ID NO: 67209 - DNA, 70 bp, Artificial Sequence
  Synthetic
gccaagcatttaggtgacactatagttatctcagggactgcactcgtttcagagctatgctggaaacagc

SEQ ID NO: 67210 - DNA, 70 bp, Artificial Sequence
  Synthetic
gccaagcatttaggtgacactatagtcaaaaaggccacggtcatcgtttcagagctatgctggaaacagc

SEQ ID NO: 67211 - DNA, 70 bp, Artificial Sequence
  Synthetic
gccaagcatttaggtgacactatagcctcagaagtcttatctggtgtttcagagctatgctggaaacagc

SEQ ID NO: 67212 - DNA, 70 bp, Artificial Sequence
  Synthetic
gccaagcatttaggtgacactatagcatctaaccccaaagaagcagtttcagagctatgctggaaacagc

SEQ ID NO: 67213 - DNA, 70 bp, Artificial Sequence
  Synthetic
gccaagcatttaggtgacactatagtgccttagcaggcatcatgagtttcagagctatgctggaaacagc

SEQ ID NO: 67214 - DNA, 70 bp, Artificial Sequence
  Synthetic
gccaagcatttaggtgacactatagcctgatctatgtgactgagtgtttcagagctatgctggaaacagc

SEQ ID NO: 67215 - DNA, 70 bp, Artificial Sequence
  Synthetic
gccaagcatttaggtgacactatagttcacagtttgtaacagacggtttcagagctatgctggaaacagc

SEQ ID NO: 67216 - DNA, 70 bp, Artificial Sequence
  Synthetic
gccaagcatttaggtgacactatagctaactcagagacatacagagtttcagagctatgctggaaacagc

SEQ ID NO: 67217 - DNA, 70 bp, Artificial Sequence
  Synthetic
gccaagcatttaggtgacactatagctcagcccctgaacaataaagtttcagagctatgctggaaacagc

SEQ ID NO: 67218 - DNA, 70 bp, Artificial Sequence
  Synthetic
gccaagcatttaggtgacactatagccacaccatttgtcacaagagtttcagagctatgctggaaacagc

SEQ ID NO: 67219 - DNA, 70 bp, Artificial Sequence
  Synthetic
gccaagcatttaggtgacactatagtgtcacaattacaaggattggtttcagagctatgctggaaacagc

SEQ ID NO: 67220 - DNA, 70 bp, Artificial Sequence
  Synthetic
gccaagcatttaggtgacactatagagcttgtgttgaaaaatagggtttcagagctatgctggaaacagc

SEQ ID NO: 67221 - DNA, 70 bp, Artificial Sequence
  Synthetic
gccaagcatttaggtgacactatagctccaccttcatcaatgagcgtttcagagctatgctggaaacagc

SEQ ID NO: 67222 - DNA, 70 bp, Artificial Sequence
  Synthetic
gccaagcatttaggtgacactatagggcccttccagggacctcaggtttcagagctatgctggaaacagc

SEQ ID NO: 67223 - DNA, 70 bp, Artificial Sequence
  Synthetic
gccaagcatttaggtgacactataggtagcatcactttcggacaggtttcagagctatgctggaaacagc

SEQ ID NO: 67224 - DNA, 70 bp, Artificial Sequence
  Synthetic
gccaagcatttaggtgacactatagacatctgccaacatatgtttgtttcagagctatgctggaaacagc

SEQ ID NO: 67225 - DNA, 70 bp, Artificial Sequence
  Synthetic
gccaagcatttaggtgacactatagagagccagagcctgcaagctgtttcagagctatgctggaaacagc

SEQ ID NO: 67226 - DNA, 70 bp, Artificial Sequence
  Synthetic
gccaagcatttaggtgacactatagtagattgcagtacagatacagtttcagagctatgctggaaacagc

SEQ ID NO: 67227 - DNA, 70 bp, Artificial Sequence
  Synthetic
gccaagcatttaggtgacactatagtcggggcgtgcgctcagcccgtttcagagctatgctggaaacagc

SEQ ID NO: 67228 - DNA, 70 bp, Artificial Sequence
  Synthetic
gccaagcatttaggtgacactatagtccagcggcatttttactaagtttcagagctatgctggaaacagc

SEQ ID NO: 67229 - DNA, 70 bp, Artificial Sequence
  Synthetic
gccaagcatttaggtgacactatagtaatacacactttgagatgggtttcagagctatgctggaaacagc

SEQ ID NO: 67230 - DNA, 70 bp, Artificial Sequence
  Synthetic
gccaagcatttaggtgacactatagtctcatcaaaggaatgcactgtttcagagctatgctggaaacagc

SEQ ID NO: 67231 - DNA, 70 bp, Artificial Sequence
  Synthetic
gccaagcatttaggtgacactatagaaggccggccatcacttctggtttcagagctatgctggaaacagc

SEQ ID NO: 67232 - DNA, 70 bp, Artificial Sequence
  Synthetic
gccaagcatttaggtgacactatagatggcaggctgggccctaatgtttcagagctatgctggaaacagc

SEQ ID NO: 67233 - DNA, 70 bp, Artificial Sequence
  Synthetic
gccaagcatttaggtgacactataggcaggctggtcttgaactgcgtttcagagctatgctggaaacagc

SEQ ID NO: 67234 - DNA, 70 bp, Artificial Sequence
  Synthetic
gccaagcatttaggtgacactatagttgctgctgtttatcaagctgtttcagagctatgctggaaacagc

SEQ ID NO: 67235 - DNA, 70 bp, Artificial Sequence
  Synthetic
gccaagcatttaggtgacactataggctcagggtataaaccacccgtttcagagctatgctggaaacagc

SEQ ID NO: 67236 - DNA, 70 bp, Artificial Sequence
  Synthetic
gccaagcatttaggtgacactataggtggtggcgggagtcttcatgtttcagagctatgctggaaacagc

SEQ ID NO: 67237 - DNA, 70 bp, Artificial Sequence
  Synthetic
gccaagcatttaggtgacactatagcttcaggccataccctctacgtttcagagctatgctggaaacagc

SEQ ID NO: 67238 - DNA, 70 bp, Artificial Sequence
  Synthetic
gccaagcatttaggtgacactatagccaaaggtcacatttctgcagtttcagagctatgctggaaacagc

SEQ ID NO: 67239 - DNA, 70 bp, Artificial Sequence
  Synthetic
gccaagcatttaggtgacactatagagtttcgtatcgcacagcaggtttcagagctatgctggaaacagc

SEQ ID NO: 67240 - DNA, 70 bp, Artificial Sequence
  Synthetic
gccaagcatttaggtgacactatagttgagttgtcaactatgcatgtttcagagctatgctggaaacagc

SEQ ID NO: 67241 - DNA, 70 bp, Artificial Sequence
  Synthetic
gccaagcatttaggtgacactatagggatccaaagtctcatagaagtttcagagctatgctggaaacagc

SEQ ID NO: 67242 - DNA, 70 bp, Artificial Sequence
  Synthetic
gccaagcatttaggtgacactatagcagtctgagagaccccgctcgtttcagagctatgctggaaacagc

SEQ ID NO: 67243 - DNA, 70 bp, Artificial Sequence
  Synthetic
gccaagcatttaggtgacactatagaggatggattctcagtaccagtttcagagctatgctggaaacagc

SEQ ID NO: 67244 - DNA, 70 bp, Artificial Sequence
  Synthetic
gccaagcatttaggtgacactatagggcagacacctactgcgcgtgtttcagagctatgctggaaacagc

SEQ ID NO: 67245 - DNA, 70 bp, Artificial Sequence
  Synthetic
gccaagcatttaggtgacactatagtcgaagctgtcagggcgagcgtttcagagctatgctggaaacagc

SEQ ID NO: 67246 - DNA, 70 bp, Artificial Sequence
  Synthetic
gccaagcatttaggtgacactatagtgggttacactatctcatacgtttcagagctatgctggaaacagc

SEQ ID NO: 67247 - DNA, 70 bp, Artificial Sequence
  Synthetic
gccaagcatttaggtgacactatagttggaagcaagcaactccaagtttcagagctatgctggaaacagc

SEQ ID NO: 67248 - DNA, 70 bp, Artificial Sequence
  Synthetic
gccaagcatttaggtgacactatagaatcagtatgagatggtgtagtttcagagctatgctggaaacagc

SEQ ID NO: 67249 - DNA, 70 bp, Artificial Sequence
  Synthetic
gccaagcatttaggtgacactatagagattcatttgttcccgatcgtttcagagctatgctggaaacagc

SEQ ID NO: 67250 - DNA, 70 bp, Artificial Sequence
  Synthetic
gccaagcatttaggtgacactatagaagaagtacgacgcatgagcgtttcagagctatgctggaaacagc

SEQ ID NO: 67251 - DNA, 70 bp, Artificial Sequence
  Synthetic
gccaagcatttaggtgacactatagctgcggctgaggacacgctggtttcagagctatgctggaaacagc

SEQ ID NO: 67252 - DNA, 70 bp, Artificial Sequence
  Synthetic
gccaagcatttaggtgacactatagggtgggccgggcactcactcgtttcagagctatgctggaaacagc

SEQ ID NO: 67253 - DNA, 70 bp, Artificial Sequence
  Synthetic
gccaagcatttaggtgacactatagcccacggagaagagtgactggtttcagagctatgctggaaacagc

SEQ ID NO: 67254 - DNA, 70 bp, Artificial Sequence
  Synthetic
gccaagcatttaggtgacactataggagaagagtccagtgctagagtttcagagctatgctggaaacagc

SEQ ID NO: 67255 - DNA, 70 bp, Artificial Sequence
  Synthetic
gccaagcatttaggtgacactatagattgcaggggattgcgccacgtttcagagctatgctggaaacagc

SEQ ID NO: 67256 - DNA, 70 bp, Artificial Sequence
  Synthetic
gccaagcatttaggtgacactataggaagagggaacagagacgtcgtttcagagctatgctggaaacagc

SEQ ID NO: 67257 - DNA, 70 bp, Artificial Sequence
  Synthetic
gccaagcatttaggtgacactatagagggcaaatgttaaccagacgtttcagagctatgctggaaacagc

SEQ ID NO: 67258 - DNA, 70 bp, Artificial Sequence
  Synthetic
gccaagcatttaggtgacactatagaaaaggggaaaacccttatcgtttcagagctatgctggaaacagc

SEQ ID NO: 67259 - DNA, 70 bp, Artificial Sequence
  Synthetic
gccaagcatttaggtgacactatagaggacagagattagccagacgtttcagagctatgctggaaacagc

SEQ ID NO: 67260 - DNA, 70 bp, Artificial Sequence
  Synthetic
gccaagcatttaggtgacactataggagacttgtgcaggatcagtgtttcagagctatgctggaaacagc

SEQ ID NO: 67261 - DNA, 70 bp, Artificial Sequence
  Synthetic
gccaagcatttaggtgacactatagaaggcaaaggttaaccacacgtttcagagctatgctggaaacagc

SEQ ID NO: 67262 - DNA, 70 bp, Artificial Sequence
  Synthetic
gccaagcatttaggtgacactatagctcaagggggcatggagtaagtttcagagctatgctggaaacagc

SEQ ID NO: 67263 - DNA, 70 bp, Artificial Sequence
  Synthetic
gccaagcatttaggtgacactatagcccatttgagttcaggggtggtttcagagctatgctggaaacagc

SEQ ID NO: 67264 - DNA, 70 bp, Artificial Sequence
  Synthetic
gccaagcatttaggtgacactataggtccggagaaaaaaatgagtgtttcagagctatgctggaaacagc

SEQ ID NO: 67265 - DNA, 70 bp, Artificial Sequence
  Synthetic
gccaagcatttaggtgacactatagagaaacggcagagagactgagtttcagagctatgctggaaacagc

SEQ ID NO: 67266 - DNA, 70 bp, Artificial Sequence
  Synthetic
gccaagcatttaggtgacactatagccaggtgctgaggtctgagagtttcagagctatgctggaaacagc

SEQ ID NO: 67267 - DNA, 70 bp, Artificial Sequence
  Synthetic
gccaagcatttaggtgacactatagctgggccgcaagaagctcacgtttcagagctatgctggaaacagc

SEQ ID NO: 67268 - DNA, 70 bp, Artificial Sequence
  Synthetic
gccaagcatttaggtgacactatagacatctccggagctgaggtggtttcagagctatgctggaaacagc

SEQ ID NO: 67269 - DNA, 70 bp, Artificial Sequence
  Synthetic
gccaagcatttaggtgacactatagtatcaagtgcttgctagccagtttcagagctatgctggaaacagc

SEQ ID NO: 67270 - DNA, 70 bp, Artificial Sequence
  Synthetic
gccaagcatttaggtgacactatagttttcaggtcgtaatttgcagtttcagagctatgctggaaacagc

SEQ ID NO: 67271 - DNA, 70 bp, Artificial Sequence
  Synthetic
gccaagcatttaggtgacactatagggaaccacccggcttctagcgtttcagagctatgctggaaacagc

SEQ ID NO: 67272 - DNA, 70 bp, Artificial Sequence
  Synthetic
gccaagcatttaggtgacactataggtcccagggaaagtctgagagtttcagagctatgctggaaacagc

SEQ ID NO: 67273 - DNA, 70 bp, Artificial Sequence
  Synthetic
gccaagcatttaggtgacactatagctgtcttccagcttcacttcgtttcagagctatgctggaaacagc

SEQ ID NO: 67274 - DNA, 70 bp, Artificial Sequence
  Synthetic
gccaagcatttaggtgacactatagctgctagctgggaggtgatggtttcagagctatgctggaaacagc

SEQ ID NO: 67275 - DNA, 70 bp, Artificial Sequence
  Synthetic
gccaagcatttaggtgacactatagttggagaaagagagttaggcgtttcagagctatgctggaaacagc

SEQ ID NO: 67276 - DNA, 70 bp, Artificial Sequence
  Synthetic
gccaagcatttaggtgacactatagggtgctgctcacataagcacgtttcagagctatgctggaaacagc

SEQ ID NO: 67277 - DNA, 70 bp, Artificial Sequence
  Synthetic
gccaagcatttaggtgacactatagaaaacactagctgtcagattgtttcagagctatgctggaaacagc

SEQ ID NO: 67278 - DNA, 70 bp, Artificial Sequence
  Synthetic
gccaagcatttaggtgacactataggagcagcgggcgtcattatcgtttcagagctatgctggaaacagc

SEQ ID NO: 67279 - DNA, 70 bp, Artificial Sequence
  Synthetic
gccaagcatttaggtgacactatagagccagtaaactcagcagatgtttcagagctatgctggaaacagc

SEQ ID NO: 67280 - DNA, 70 bp, Artificial Sequence
  Synthetic
gccaagcatttaggtgacactataggaaattgatggagtacgagcgtttcagagctatgctggaaacagc

SEQ ID NO: 67281 - DNA, 70 bp, Artificial Sequence
  Synthetic
gccaagcatttaggtgacactatagtcgtagagttgagaatttctgtttcagagctatgctggaaacagc

SEQ ID NO: 67282 - DNA, 70 bp, Artificial Sequence
  Synthetic
gccaagcatttaggtgacactatagtagagtttcttaagacaacggtttcagagctatgctggaaacagc

SEQ ID NO: 67283 - DNA, 70 bp, Artificial Sequence
  Synthetic
gccaagcatttaggtgacactatagcataaacctaagcctacccggtttcagagctatgctggaaacagc

SEQ ID NO: 67284 - DNA, 70 bp, Artificial Sequence
  Synthetic
gccaagcatttaggtgacactatagctacttagtgcatcttcttcgtttcagagctatgctggaaacagc

SEQ ID NO: 67285 - DNA, 70 bp, Artificial Sequence
  Synthetic
gccaagcatttaggtgacactatagtgagacttttaaagatgcaggtttcagagctatgctggaaacagc

SEQ ID NO: 67286 - DNA, 70 bp, Artificial Sequence
  Synthetic
gccaagcatttaggtgacactatagctactatgaagctgtctgaagtttcagagctatgctggaaacagc

SEQ ID NO: 67287 - DNA, 70 bp, Artificial Sequence
  Synthetic
gccaagcatttaggtgacactatagacttaatgctgaagaagggagtttcagagctatgctggaaacagc

SEQ ID NO: 67288 - DNA, 70 bp, Artificial Sequence
  Synthetic
gccaagcatttaggtgacactatagttatgtctatggcactttccgtttcagagctatgctggaaacagc

SEQ ID NO: 67289 - DNA, 70 bp, Artificial Sequence
  Synthetic
gccaagcatttaggtgacactatagagcttgacagaatttgtcaagtttcagagctatgctggaaacagc

SEQ ID NO: 67290 - DNA, 70 bp, Artificial Sequence
  Synthetic
gccaagcatttaggtgacactatagaggtccctgaggccctagctgtttcagagctatgctggaaacagc

SEQ ID NO: 67291 - DNA, 70 bp, Artificial Sequence
  Synthetic
gccaagcatttaggtgacactatagttcaaggtcttaaagacgcagtttcagagctatgctggaaacagc

SEQ ID NO: 67292 - DNA, 70 bp, Artificial Sequence
  Synthetic
gccaagcatttaggtgacactatagcgccgggctgtctcattctagtttcagagctatgctggaaacagc

SEQ ID NO: 67293 - DNA, 70 bp, Artificial Sequence
  Synthetic
gccaagcatttaggtgacactatagtgggtgtagtggctcacaccgtttcagagctatgctggaaacagc

SEQ ID NO: 67294 - DNA, 70 bp, Artificial Sequence
  Synthetic
gccaagcatttaggtgacactatagcccggcacaacagcagactggtttcagagctatgctggaaacagc

SEQ ID NO: 67295 - DNA, 70 bp, Artificial Sequence
  Synthetic
gccaagcatttaggtgacactatagtgtccaaaatggagaaaaacgtttcagagctatgctggaaacagc

SEQ ID NO: 67296 - DNA, 70 bp, Artificial Sequence
  Synthetic
gccaagcatttaggtgacactatagcagaggagacccatggagtcgtttcagagctatgctggaaacagc

SEQ ID NO: 67297 - DNA, 70 bp, Artificial Sequence
  Synthetic
gccaagcatttaggtgacactatagaacaggaaatgagatggaaagtttcagagctatgctggaaacagc

SEQ ID NO: 67298 - DNA, 70 bp, Artificial Sequence
  Synthetic
gccaagcatttaggtgacactatagactgaggaaaaccaactacggtttcagagctatgctggaaacagc

SEQ ID NO: 67299 - DNA, 70 bp, Artificial Sequence
  Synthetic
gccaagcatttaggtgacactatagaggactgaactcagtcaagagtttcagagctatgctggaaacagc

SEQ ID NO: 67300 - DNA, 70 bp, Artificial Sequence
  Synthetic
gccaagcatttaggtgacactatagctccatttactgagaagcacgtttcagagctatgctggaaacagc

SEQ ID NO: 67301 - DNA, 70 bp, Artificial Sequence
  Synthetic
gccaagcatttaggtgacactataggacgctggcgctattttagagtttcagagctatgctggaaacagc

SEQ ID NO: 67302 - DNA, 70 bp, Artificial Sequence
  Synthetic
gccaagcatttaggtgacactataggatttcgaaactggttgcttgtttcagagctatgctggaaacagc

SEQ ID NO: 67303 - DNA, 70 bp, Artificial Sequence
  Synthetic
gccaagcatttaggtgacactatagatgctttagcatttggaagagtttcagagctatgctggaaacagc

SEQ ID NO: 67304 - DNA, 70 bp, Artificial Sequence
  Synthetic
gccaagcatttaggtgacactatagaacgtttggaagaactcagtgtttcagagctatgctggaaacagc

SEQ ID NO: 67305 - DNA, 70 bp, Artificial Sequence
  Synthetic
gccaagcatttaggtgacactatagagctgccttcctgctcttctgtttcagagctatgctggaaacagc

SEQ ID NO: 67306 - DNA, 70 bp, Artificial Sequence
  Synthetic
gccaagcatttaggtgacactatagcatgcattctttcttcttcggtttcagagctatgctggaaacagc

SEQ ID NO: 67307 - DNA, 70 bp, Artificial Sequence
  Synthetic
gccaagcatttaggtgacactatagatacagtcacatatgagtctgtttcagagctatgctggaaacagc

SEQ ID NO: 67308 - DNA, 70 bp, Artificial Sequence
  Synthetic
gccaagcatttaggtgacactatagctgtctcaggccagatgagggtttcagagctatgctggaaacagc

SEQ ID NO: 67309 - DNA, 70 bp, Artificial Sequence
  Synthetic
gccaagcatttaggtgacactatagaaagtagcatcttgaaatccgtttcagagctatgctggaaacagc

SEQ ID NO: 67310 - DNA, 70 bp, Artificial Sequence
  Synthetic
gccaagcatttaggtgacactatagtcctatgcatactgcttcatgtttcagagctatgctggaaacagc

SEQ ID NO: 67311 - DNA, 70 bp, Artificial Sequence
  Synthetic
gccaagcatttaggtgacactataggggaggcatcctcaggctgcgtttcagagctatgctggaaacagc

SEQ ID NO: 67312 - DNA, 70 bp, Artificial Sequence
  Synthetic
gccaagcatttaggtgacactatagcccgggtccgcggcgctcaggtttcagagctatgctggaaacagc

SEQ ID NO: 67313 - DNA, 70 bp, Artificial Sequence
  Synthetic
gccaagcatttaggtgacactatagtcatggagatacaagagcatgtttcagagctatgctggaaacagc

SEQ ID NO: 67314 - DNA, 70 bp, Artificial Sequence
  Synthetic
gccaagcatttaggtgacactatagccaggctggctcactgcatggtttcagagctatgctggaaacagc

SEQ ID NO: 67315 - DNA, 70 bp, Artificial Sequence
  Synthetic
gccaagcatttaggtgacactatagaactgctgcacaaagctacagtttcagagctatgctggaaacagc

SEQ ID NO: 67316 - DNA, 70 bp, Artificial Sequence
  Synthetic
gccaagcatttaggtgacactatagacatcgtgctcccactgtgtgtttcagagctatgctggaaacagc

SEQ ID NO: 67317 - DNA, 70 bp, Artificial Sequence
  Synthetic
gccaagcatttaggtgacactatagttcaagttctgatcaatctggtttcagagctatgctggaaacagc

SEQ ID NO: 67318 - DNA, 70 bp, Artificial Sequence
  Synthetic
gccaagcatttaggtgacactataggtgttccgggtctgtcactggtttcagagctatgctggaaacagc

SEQ ID NO: 67319 - DNA, 70 bp, Artificial Sequence
  Synthetic
gccaagcatttaggtgacactatagttcagacagtgtaatagttggtttcagagctatgctggaaacagc

SEQ ID NO: 67320 - DNA, 70 bp, Artificial Sequence
  Synthetic
gccaagcatttaggtgacactatagcctggcttagtcatcgtatcgtttcagagctatgctggaaacagc

SEQ ID NO: 67321 - DNA, 70 bp, Artificial Sequence
  Synthetic
gccaagcatttaggtgacactataggtcaaaggtcattcacactggtttcagagctatgctggaaacagc

SEQ ID NO: 67322 - DNA, 70 bp, Artificial Sequence
  Synthetic
gccaagcatttaggtgacactatagagtcttcaagatcaagtgctgtttcagagctatgctggaaacagc

SEQ ID NO: 67323 - DNA, 70 bp, Artificial Sequence
  Synthetic
gccaagcatttaggtgacactataggcagcgtcgtcagagctctcgtttcagagctatgctggaaacagc

SEQ ID NO: 67324 - DNA, 70 bp, Artificial Sequence
  Synthetic
gccaagcatttaggtgacactatagatcccccgcgtgctctgagcgtttcagagctatgctggaaacagc

SEQ ID NO: 67325 - DNA, 70 bp, Artificial Sequence
  Synthetic
gccaagcatttaggtgacactatagttaaatgttgtgtgtccacagtttcagagctatgctggaaacagc

SEQ ID NO: 67326 - DNA, 70 bp, Artificial Sequence
  Synthetic
gccaagcatttaggtgacactataggaaaaagaagccatgtaaccgtttcagagctatgctggaaacagc

SEQ ID NO: 67327 - DNA, 70 bp, Artificial Sequence
  Synthetic
gccaagcatttaggtgacactatagactcgggatgtaattggctggtttcagagctatgctggaaacagc

SEQ ID NO: 67328 - DNA, 70 bp, Artificial Sequence
  Synthetic
gccaagcatttaggtgacactatagcagctctacctgggcatgttgtttcagagctatgctggaaacagc

SEQ ID NO: 67329 - DNA, 70 bp, Artificial Sequence
  Synthetic
gccaagcatttaggtgacactatagcaaggccggtggatcatctggtttcagagctatgctggaaacagc

SEQ ID NO: 67330 - DNA, 70 bp, Artificial Sequence
  Synthetic
gccaagcatttaggtgacactatagcaggaggttagatgccaaaagtttcagagctatgctggaaacagc

SEQ ID NO: 67331 - DNA, 70 bp, Artificial Sequence
  Synthetic
gccaagcatttaggtgacactatagcaacgtgctccagctgctcagtttcagagctatgctggaaacagc

SEQ ID NO: 67332 - DNA, 70 bp, Artificial Sequence
  Synthetic
gccaagcatttaggtgacactatagtctgaaggcgcaccctacaagtttcagagctatgctggaaacagc

SEQ ID NO: 67333 - DNA, 70 bp, Artificial Sequence
  Synthetic
gccaagcatttaggtgacactataggcagctttcaaaatggagttgtttcagagctatgctggaaacagc

SEQ ID NO: 67334 - DNA, 70 bp, Artificial Sequence
  Synthetic
gccaagcatttaggtgacactatagcctctgtcacagcttgatgagtttcagagctatgctggaaacagc

SEQ ID NO: 67335 - DNA, 70 bp, Artificial Sequence
  Synthetic
gccaagcatttaggtgacactatagtccaggtgggactcacttccgtttcagagctatgctggaaacagc

SEQ ID NO: 67336 - DNA, 70 bp, Artificial Sequence
  Synthetic
gccaagcatttaggtgacactatagctgagaacgcgaggccctaggtttcagagctatgctggaaacagc

SEQ ID NO: 67337 - DNA, 70 bp, Artificial Sequence
  Synthetic
gccaagcatttaggtgacactataggagggatctcactcccagacgtttcagagctatgctggaaacagc

SEQ ID NO: 67338 - DNA, 70 bp, Artificial Sequence
  Synthetic
gccaagcatttaggtgacactatagccagacataccctgtcctgagtttcagagctatgctggaaacagc

SEQ ID NO: 67339 - DNA, 70 bp, Artificial Sequence
  Synthetic
gccaagcatttaggtgacactatagagggctctctggcttcgtgtgtttcagagctatgctggaaacagc

SEQ ID NO: 67340 - DNA, 70 bp, Artificial Sequence
  Synthetic
gccaagcatttaggtgacactatagggacagcgagtgcctagacagtttcagagctatgctggaaacagc

SEQ ID NO: 67341 - DNA, 70 bp, Artificial Sequence
  Synthetic
gccaagcatttaggtgacactatagtcattagtttctggagctctgtttcagagctatgctggaaacagc

SEQ ID NO: 67342 - DNA, 70 bp, Artificial Sequence
  Synthetic
gccaagcatttaggtgacactataggggtccacagcaagagcctggtttcagagctatgctggaaacagc

SEQ ID NO: 67343 - DNA, 70 bp, Artificial Sequence
  Synthetic
gccaagcatttaggtgacactatagtttggagagaggccagttatgtttcagagctatgctggaaacagc

SEQ ID NO: 67344 - DNA, 70 bp, Artificial Sequence
  Synthetic
gccaagcatttaggtgacactatagagagctggtgatgggcacaagtttcagagctatgctggaaacagc

SEQ ID NO: 67345 - DNA, 70 bp, Artificial Sequence
  Synthetic
gccaagcatttaggtgacactatagctggccaaaaaggatgtgaggtttcagagctatgctggaaacagc

SEQ ID NO: 67346 - DNA, 70 bp, Artificial Sequence
  Synthetic
gccaagcatttaggtgacactatagcttcccttctgtttcacagagtttcagagctatgctggaaacagc

SEQ ID NO: 67347 - DNA, 70 bp, Artificial Sequence
  Synthetic
gccaagcatttaggtgacactatagcgtccgccgcccggaggaaagtttcagagctatgctggaaacagc

SEQ ID NO: 67348 - DNA, 70 bp, Artificial Sequence
  Synthetic
gccaagcatttaggtgacactatagcctggcagctggggatcaacgtttcagagctatgctggaaacagc

SEQ ID NO: 67349 - DNA, 70 bp, Artificial Sequence
  Synthetic
gccaagcatttaggtgacactatagagctacaaacaaatcaggaagtttcagagctatgctggaaacagc

SEQ ID NO: 67350 - DNA, 70 bp, Artificial Sequence
  Synthetic
gccaagcatttaggtgacactatagagggcacaggccctcttaaagtttcagagctatgctggaaacagc

SEQ ID NO: 67351 - DNA, 70 bp, Artificial Sequence
  Synthetic
gccaagcatttaggtgacactatagtggaggacatttgtcaggaagtttcagagctatgctggaaacagc

SEQ ID NO: 67352 - DNA, 70 bp, Artificial Sequence
  Synthetic
gccaagcatttaggtgacactatagctgggggacgggctagtagcgtttcagagctatgctggaaacagc

SEQ ID NO: 67353 - DNA, 70 bp, Artificial Sequence
  Synthetic
gccaagcatttaggtgacactatagtcaccaatcccaaggaatgagtttcagagctatgctggaaacagc

SEQ ID NO: 67354 - DNA, 70 bp, Artificial Sequence
  Synthetic
gccaagcatttaggtgacactataggcccaggcaggctgggttaggtttcagagctatgctggaaacagc

SEQ ID NO: 67355 - DNA, 70 bp, Artificial Sequence
  Synthetic
gccaagcatttaggtgacactatagaatccaagcgctttgtgcaggtttcagagctatgctggaaacagc

SEQ ID NO: 67356 - DNA, 70 bp, Artificial Sequence
  Synthetic
gccaagcatttaggtgacactatagcccccgaaagtctgttaggcgtttcagagctatgctggaaacagc

SEQ ID NO: 67357 - DNA, 70 bp, Artificial Sequence
  Synthetic
gccaagcatttaggtgacactatagggctgccgggcgcggtctaggtttcagagctatgctggaaacagc

SEQ ID NO: 67358 - DNA, 70 bp, Artificial Sequence
  Synthetic
gccaagcatttaggtgacactataggcaagctggcgtgcgagtaggtttcagagctatgctggaaacagc

SEQ ID NO: 67359 - DNA, 70 bp, Artificial Sequence
  Synthetic
gccaagcatttaggtgacactatagagagggtgaggaagaaggaggtttcagagctatgctggaaacagc

SEQ ID NO: 67360 - DNA, 70 bp, Artificial Sequence
  Synthetic
gccaagcatttaggtgacactatagagtgctgacggagaggatgagtttcagagctatgctggaaacagc

SEQ ID NO: 67361 - DNA, 70 bp, Artificial Sequence
  Synthetic
gccaagcatttaggtgacactatagagaaggtgaagaatactgaggtttcagagctatgctggaaacagc

SEQ ID NO: 67362 - DNA, 70 bp, Artificial Sequence
  Synthetic
gccaagcatttaggtgacactatagagaaggcgaagaatactgaggtttcagagctatgctggaaacagc

SEQ ID NO: 67363 - DNA, 70 bp, Artificial Sequence
  Synthetic
gccaagcatttaggtgacactatagtcctatgaggacgaggatgagtttcagagctatgctggaaacagc

SEQ ID NO: 67364 - DNA, 70 bp, Artificial Sequence
  Synthetic
gccaagcatttaggtgacactatagtgaagaagaaaatgaagggggtttcagagctatgctggaaacagc

SEQ ID NO: 67365 - DNA, 70 bp, Artificial Sequence
  Synthetic
gccaagcatttaggtgacactataggaagtggcgcaaagtttctggtttcagagctatgctggaaacagc

SEQ ID NO: 67366 - DNA, 70 bp, Artificial Sequence
  Synthetic
gccaagcatttaggtgacactataggaggccgaagaggaggcctagtttcagagctatgctggaaacagc

SEQ ID NO: 67367 - DNA, 70 bp, Artificial Sequence
  Synthetic
gccaagcatttaggtgacactataggaaatggagccagaagataagtttcagagctatgctggaaacagc

SEQ ID NO: 67368 - DNA, 70 bp, Artificial Sequence
  Synthetic
gccaagcatttaggtgacactatagggaggaggagggcgaggacggtttcagagctatgctggaaacagc

SEQ ID NO: 67369 - DNA, 70 bp, Artificial Sequence
  Synthetic
gccaagcatttaggtgacactatagcagctgcgagcagcttcactgtttcagagctatgctggaaacagc

SEQ ID NO: 67370 - DNA, 70 bp, Artificial Sequence
  Synthetic
gccaagcatttaggtgacactatagggcggaggaggaggtggcctgtttcagagctatgctggaaacagc

SEQ ID NO: 67371 - DNA, 70 bp, Artificial Sequence
  Synthetic
gccaagcatttaggtgacactatagggaggaggctgaggaggagggtttcagagctatgctggaaacagc

SEQ ID NO: 67372 - DNA, 70 bp, Artificial Sequence
  Synthetic
gccaagcatttaggtgacactatagagaggagatcgatggatagtgtttcagagctatgctggaaacagc

SEQ ID NO: 67373 - DNA, 70 bp, Artificial Sequence
  Synthetic
gccaagcatttaggtgacactatagcaggggaactgaggagaaacgtttcagagctatgctggaaacagc

SEQ ID NO: 67374 - DNA, 70 bp, Artificial Sequence
  Synthetic
gccaagcatttaggtgacactatagggagtatgccgaggaggagggtttcagagctatgctggaaacagc

SEQ ID NO: 67375 - DNA, 70 bp, Artificial Sequence
  Synthetic
gccaagcatttaggtgacactatagagatcagagattacagtaacgtttcagagctatgctggaaacagc

SEQ ID NO: 67376 - DNA, 70 bp, Artificial Sequence
  Synthetic
gccaagcatttaggtgacactatagtcacatagctatgcttagtcgtttcagagctatgctggaaacagc

SEQ ID NO: 67377 - DNA, 70 bp, Artificial Sequence
  Synthetic
gccaagcatttaggtgacactatagcctgggggactcactgctccgtttcagagctatgctggaaacagc

SEQ ID NO: 67378 - DNA, 70 bp, Artificial Sequence
  Synthetic
gccaagcatttaggtgacactataggggagggaaatcactgctccgtttcagagctatgctggaaacagc

SEQ ID NO: 67379 - DNA, 70 bp, Artificial Sequence
  Synthetic
gccaagcatttaggtgacactatagcacagccagggctcactgtggtttcagagctatgctggaaacagc

SEQ ID NO: 67380 - DNA, 70 bp, Artificial Sequence
  Synthetic
gccaagcatttaggtgacactatagaggaccgcgagcttcacgtggtttcagagctatgctggaaacagc

SEQ ID NO: 67381 - DNA, 70 bp, Artificial Sequence
  Synthetic
gccaagcatttaggtgacactatagcgggacttcaaacgcagtatgtttcagagctatgctggaaacagc

SEQ ID NO: 67382 - DNA, 70 bp, Artificial Sequence
  Synthetic
gccaagcatttaggtgacactatagtgtttcagaactcgtttgtagtttcagagctatgctggaaacagc

SEQ ID NO: 67383 - DNA, 70 bp, Artificial Sequence
  Synthetic
gccaagcatttaggtgacactatagacccaggctggtggaactctgtttcagagctatgctggaaacagc

SEQ ID NO: 67384 - DNA, 70 bp, Artificial Sequence
  Synthetic
gccaagcatttaggtgacactataggatatactcacaatggggaagtttcagagctatgctggaaacagc

SEQ ID NO: 67385 - DNA, 70 bp, Artificial Sequence
  Synthetic
gccaagcatttaggtgacactatagggtcggtaatcccagcatttgtttcagagctatgctggaaacagc

SEQ ID NO: 67386 - DNA, 70 bp, Artificial Sequence
  Synthetic
gccaagcatttaggtgacactataggttgtcactcatggctggcagtttcagagctatgctggaaacagc

SEQ ID NO: 67387 - DNA, 70 bp, Artificial Sequence
  Synthetic
gccaagcatttaggtgacactatagaactactaccaggacgcctggtttcagagctatgctggaaacagc

SEQ ID NO: 67388 - DNA, 70 bp, Artificial Sequence
  Synthetic
gccaagcatttaggtgacactatagaggaggagaagaatatcaaagtttcagagctatgctggaaacagc

SEQ ID NO: 67389 - DNA, 70 bp, Artificial Sequence
  Synthetic
gccaagcatttaggtgacactatagcagctcaggtttccaccactgtttcagagctatgctggaaacagc

SEQ ID NO: 67390 - DNA, 70 bp, Artificial Sequence
  Synthetic
gccaagcatttaggtgacactataggggctgctggggtcactcgcgtttcagagctatgctggaaacagc

SEQ ID NO: 67391 - DNA, 70 bp, Artificial Sequence
  Synthetic
gccaagcatttaggtgacactatagagccagcttctaattgaaacgtttcagagctatgctggaaacagc

SEQ ID NO: 67392 - DNA, 70 bp, Artificial Sequence
  Synthetic
gccaagcatttaggtgacactatagcacatcagataagcatgtgagtttcagagctatgctggaaacagc

SEQ ID NO: 67393 - DNA, 70 bp, Artificial Sequence
  Synthetic
gccaagcatttaggtgacactatagttctagctttgacagtaagcgtttcagagctatgctggaaacagc

SEQ ID NO: 67394 - DNA, 70 bp, Artificial Sequence
  Synthetic
gccaagcatttaggtgacactatagatgcagtttggacggattgagtttcagagctatgctggaaacagc

SEQ ID NO: 67395 - DNA, 70 bp, Artificial Sequence
  Synthetic
gccaagcatttaggtgacactatagcacaccagtctcttcatttggtttcagagctatgctggaaacagc

SEQ ID NO: 67396 - DNA, 70 bp, Artificial Sequence
  Synthetic
gccaagcatttaggtgacactatagctgcggcctcggctacagccgtttcagagctatgctggaaacagc

SEQ ID NO: 67397 - DNA, 70 bp, Artificial Sequence
  Synthetic
gccaagcatttaggtgacactatagcccagggtcacacctcataggtttcagagctatgctggaaacagc

SEQ ID NO: 67398 - DNA, 70 bp, Artificial Sequence
  Synthetic
gccaagcatttaggtgacactatagatatttcgttccaagtaccagtttcagagctatgctggaaacagc

SEQ ID NO: 67399 - DNA, 70 bp, Artificial Sequence
  Synthetic
gccaagcatttaggtgacactatagggctccgtctggtgctgcttgtttcagagctatgctggaaacagc

SEQ ID NO: 67400 - DNA, 70 bp, Artificial Sequence
  Synthetic
gccaagcatttaggtgacactatagttgagatgtcgaattgcttggtttcagagctatgctggaaacagc

SEQ ID NO: 67401 - DNA, 70 bp, Artificial Sequence
  Synthetic
gccaagcatttaggtgacactataggctggagattcaccagcattgtttcagagctatgctggaaacagc

SEQ ID NO: 67402 - DNA, 70 bp, Artificial Sequence
  Synthetic
gccaagcatttaggtgacactatagagcatggctacttcatatttgtttcagagctatgctggaaacagc

SEQ ID NO: 67403 - DNA, 70 bp, Artificial Sequence
  Synthetic
gccaagcatttaggtgacactatagtcttctccttcagagtaaaggtttcagagctatgctggaaacagc

SEQ ID NO: 67404 - DNA, 70 bp, Artificial Sequence
  Synthetic
gccaagcatttaggtgacactatagccaaaatttcatctggcatcgtttcagagctatgctggaaacagc

SEQ ID NO: 67405 - DNA, 70 bp, Artificial Sequence
  Synthetic
gccaagcatttaggtgacactatagctccttcacagtaaagtggcgtttcagagctatgctggaaacagc

SEQ ID NO: 67406 - DNA, 70 bp, Artificial Sequence
  Synthetic
gccaagcatttaggtgacactataggtagtagcttcagtttccgcgtttcagagctatgctggaaacagc

SEQ ID NO: 67407 - DNA, 70 bp, Artificial Sequence
  Synthetic
gccaagcatttaggtgacactatagaaatggggatgacagctagggtttcagagctatgctggaaacagc

SEQ ID NO: 67408 - DNA, 70 bp, Artificial Sequence
  Synthetic
gccaagcatttaggtgacactatagtggggggctccgcctgctaggtttcagagctatgctggaaacagc

SEQ ID NO: 67409 - DNA, 70 bp, Artificial Sequence
  Synthetic
gccaagcatttaggtgacactatagggtgggtggcgcggcgctaggtttcagagctatgctggaaacagc

SEQ ID NO: 67410 - DNA, 70 bp, Artificial Sequence
  Synthetic
gccaagcatttaggtgacactatagtttggtgagcatttcaaagggtttcagagctatgctggaaacagc

SEQ ID NO: 67411 - DNA, 70 bp, Artificial Sequence
  Synthetic
gccaagcatttaggtgacactatagcaaagcttgagctccgctaagtttcagagctatgctggaaacagc

SEQ ID NO: 67412 - DNA, 70 bp, Artificial Sequence
  Synthetic
gccaagcatttaggtgacactatagcctccaagcgttcaaagtgagtttcagagctatgctggaaacagc

SEQ ID NO: 67413 - DNA, 70 bp, Artificial Sequence
  Synthetic
gccaagcatttaggtgacactatagggtccagaatgtattgactagtttcagagctatgctggaaacagc

SEQ ID NO: 67414 - DNA, 70 bp, Artificial Sequence
  Synthetic
gccaagcatttaggtgacactataggattgcggaaacctggtgacgtttcagagctatgctggaaacagc

SEQ ID NO: 67415 - DNA, 70 bp, Artificial Sequence
  Synthetic
gccaagcatttaggtgacactatagacaccaggctctctaggcccgtttcagagctatgctggaaacagc

SEQ ID NO: 67416 - DNA, 70 bp, Artificial Sequence
  Synthetic
gccaagcatttaggtgacactataggtggctgacaccaatctggagtttcagagctatgctggaaacagc

SEQ ID NO: 67417 - DNA, 70 bp, Artificial Sequence
  Synthetic
gccaagcatttaggtgacactatagctctgctccggccatcgagtgtttcagagctatgctggaaacagc

SEQ ID NO: 67418 - DNA, 70 bp, Artificial Sequence
  Synthetic
gccaagcatttaggtgacactatagggcttcaagcttttccttatgtttcagagctatgctggaaacagc

SEQ ID NO: 67419 - DNA, 70 bp, Artificial Sequence
  Synthetic
gccaagcatttaggtgacactataggccttcctgaagaagctgatgtttcagagctatgctggaaacagc

SEQ ID NO: 67420 - DNA, 70 bp, Artificial Sequence
  Synthetic
gccaagcatttaggtgacactatagctgaaaggaataaggagaacgtttcagagctatgctggaaacagc

SEQ ID NO: 67421 - DNA, 70 bp, Artificial Sequence
  Synthetic
gccaagcatttaggtgacactataggaagctcaggaaaggctgacgtttcagagctatgctggaaacagc

SEQ ID NO: 67422 - DNA, 70 bp, Artificial Sequence
  Synthetic
gccaagcatttaggtgacactatagaggacaagagcaggaacatggtttcagagctatgctggaaacagc

SEQ ID NO: 67423 - DNA, 70 bp, Artificial Sequence
  Synthetic
gccaagcatttaggtgacactatagagatgtgcaggagaatgatagtttcagagctatgctggaaacagc

SEQ ID NO: 67424 - DNA, 70 bp, Artificial Sequence
  Synthetic
gccaagcatttaggtgacactatagcagagaacaacatttccaccgtttcagagctatgctggaaacagc

SEQ ID NO: 67425 - DNA, 70 bp, Artificial Sequence
  Synthetic
gccaagcatttaggtgacactatagtgaactttgcggcgcccttagtttcagagctatgctggaaacagc

SEQ ID NO: 67426 - DNA, 70 bp, Artificial Sequence
  Synthetic
gccaagcatttaggtgacactatagccaagcgaaagacgaactttgtttcagagctatgctggaaacagc

SEQ ID NO: 67427 - DNA, 70 bp, Artificial Sequence
  Synthetic
gccaagcatttaggtgacactatagaggactttgcttaagcagctgtttcagagctatgctggaaacagc

SEQ ID NO: 67428 - DNA, 70 bp, Artificial Sequence
  Synthetic
gccaagcatttaggtgacactatagtgcagatgatggaaatgagtgtttcagagctatgctggaaacagc

SEQ ID NO: 67429 - DNA, 70 bp, Artificial Sequence
  Synthetic
gccaagcatttaggtgacactatagctggaaaagaaaactatccggtttcagagctatgctggaaacagc

SEQ ID NO: 67430 - DNA, 70 bp, Artificial Sequence
  Synthetic
gccaagcatttaggtgacactatagctcactgcacattgttgttggtttcagagctatgctggaaacagc

SEQ ID NO: 67431 - DNA, 70 bp, Artificial Sequence
  Synthetic
gccaagcatttaggtgacactatagcagtgtcttttgtaccttaggtttcagagctatgctggaaacagc

SEQ ID NO: 67432 - DNA, 70 bp, Artificial Sequence
  Synthetic
gccaagcatttaggtgacactatagtccaccaagtaccgctactggtttcagagctatgctggaaacagc

SEQ ID NO: 67433 - DNA, 70 bp, Artificial Sequence
  Synthetic
gccaagcatttaggtgacactatagctctccttttgtcttattccgtttcagagctatgctggaaacagc

SEQ ID NO: 67434 - DNA, 70 bp, Artificial Sequence
  Synthetic
gccaagcatttaggtgacactatagtcttgggatcaataggacttgtttcagagctatgctggaaacagc

SEQ ID NO: 67435 - DNA, 70 bp, Artificial Sequence
  Synthetic
gccaagcatttaggtgacactatagatcctccaggctggctgctggtttcagagctatgctggaaacagc

SEQ ID NO: 67436 - DNA, 70 bp, Artificial Sequence
  Synthetic
gccaagcatttaggtgacactatagaaccagagaagagactgagagtttcagagctatgctggaaacagc

SEQ ID NO: 67437 - DNA, 70 bp, Artificial Sequence
  Synthetic
gccaagcatttaggtgacactatagccacggtgacaggctgctgagtttcagagctatgctggaaacagc

SEQ ID NO: 67438 - DNA, 70 bp, Artificial Sequence
  Synthetic
gccaagcatttaggtgacactatagatcactcagaaaggctgctggtttcagagctatgctggaaacagc

SEQ ID NO: 67439 - DNA, 70 bp, Artificial Sequence
  Synthetic
gccaagcatttaggtgacactatagagaaaggatgatgtttgcccgtttcagagctatgctggaaacagc

SEQ ID NO: 67440 - DNA, 70 bp, Artificial Sequence
  Synthetic
gccaagcatttaggtgacactatagtcagtgttcagcgtgtgctggtttcagagctatgctggaaacagc

SEQ ID NO: 67441 - DNA, 70 bp, Artificial Sequence
  Synthetic
gccaagcatttaggtgacactataggcaaaggagctttattgctggtttcagagctatgctggaaacagc

SEQ ID NO: 67442 - DNA, 70 bp, Artificial Sequence
  Synthetic
gccaagcatttaggtgacactatagtccgcatccaactattaaaagtttcagagctatgctggaaacagc

SEQ ID NO: 67443 - DNA, 70 bp, Artificial Sequence
  Synthetic
gccaagcatttaggtgacactatagcctccgctgcggcgtcaggagtttcagagctatgctggaaacagc

SEQ ID NO: 67444 - DNA, 70 bp, Artificial Sequence
  Synthetic
gccaagcatttaggtgacactatagaatggctctgatacaagctggtttcagagctatgctggaaacagc

SEQ ID NO: 67445 - DNA, 70 bp, Artificial Sequence
  Synthetic
gccaagcatttaggtgacactataggtgggctaacagctactgtggtttcagagctatgctggaaacagc

SEQ ID NO: 67446 - DNA, 70 bp, Artificial Sequence
  Synthetic
gccaagcatttaggtgacactatagattcgggctcatttgtaatagtttcagagctatgctggaaacagc

SEQ ID NO: 67447 - DNA, 70 bp, Artificial Sequence
  Synthetic
gccaagcatttaggtgacactatagccagaatcctaatcagtctggtttcagagctatgctggaaacagc

SEQ ID NO: 67448 - DNA, 70 bp, Artificial Sequence
  Synthetic
gccaagcatttaggtgacactataggccccgcggagcaagctctggtttcagagctatgctggaaacagc

SEQ ID NO: 67449 - DNA, 70 bp, Artificial Sequence
  Synthetic
gccaagcatttaggtgacactatagcaacacccgggacaataatagtttcagagctatgctggaaacagc

SEQ ID NO: 67450 - DNA, 70 bp, Artificial Sequence
  Synthetic
gccaagcatttaggtgacactatagtctctgatgtcttgtgtcctgtttcagagctatgctggaaacagc

SEQ ID NO: 67451 - DNA, 70 bp, Artificial Sequence
  Synthetic
gccaagcatttaggtgacactatagaccaaagcttagtaatcttcgtttcagagctatgctggaaacagc

SEQ ID NO: 67452 - DNA, 70 bp, Artificial Sequence
  Synthetic
gccaagcatttaggtgacactatagttactcagagttcttgctgtgtttcagagctatgctggaaacagc

SEQ ID NO: 67453 - DNA, 70 bp, Artificial Sequence
  Synthetic
gccaagcatttaggtgacactatagcgagagatcgtgaaagatctgtttcagagctatgctggaaacagc

SEQ ID NO: 67454 - DNA, 70 bp, Artificial Sequence
  Synthetic
gccaagcatttaggtgacactatagacagattacattatggagccgtttcagagctatgctggaaacagc

SEQ ID NO: 67455 - DNA, 70 bp, Artificial Sequence
  Synthetic
gccaagcatttaggtgacactatagcactggcatggccgcttctggtttcagagctatgctggaaacagc

SEQ ID NO: 67456 - DNA, 70 bp, Artificial Sequence
  Synthetic
gccaagcatttaggtgacactatagaccgccgggacttctggtaggtttcagagctatgctggaaacagc

SEQ ID NO: 67457 - DNA, 70 bp, Artificial Sequence
  Synthetic
gccaagcatttaggtgacactataggactttttatgagacctgtggtttcagagctatgctggaaacagc

SEQ ID NO: 67458 - DNA, 70 bp, Artificial Sequence
  Synthetic
gccaagcatttaggtgacactatagagatcatacaaatgcggcaggtttcagagctatgctggaaacagc

SEQ ID NO: 67459 - DNA, 70 bp, Artificial Sequence
  Synthetic
gccaagcatttaggtgacactataggttcatgagctggtgaaaaagtttcagagctatgctggaaacagc

SEQ ID NO: 67460 - DNA, 70 bp, Artificial Sequence
  Synthetic
gccaagcatttaggtgacactatagggccagggagccgcagctgcgtttcagagctatgctggaaacagc

SEQ ID NO: 67461 - DNA, 70 bp, Artificial Sequence
  Synthetic
gccaagcatttaggtgacactatagagaggagcagacggggtcaggtttcagagctatgctggaaacagc

SEQ ID NO: 67462 - DNA, 70 bp, Artificial Sequence
  Synthetic
gccaagcatttaggtgacactataggaggtcacgtatagaacagagtttcagagctatgctggaaacagc

SEQ ID NO: 67463 - DNA, 70 bp, Artificial Sequence
  Synthetic
gccaagcatttaggtgacactatagagtttgaatagtacagtctggtttcagagctatgctggaaacagc

SEQ ID NO: 67464 - DNA, 70 bp, Artificial Sequence
  Synthetic
gccaagcatttaggtgacactatagtattcttcattttggccatggtttcagagctatgctggaaacagc

SEQ ID NO: 67465 - DNA, 70 bp, Artificial Sequence
  Synthetic
gccaagcatttaggtgacactatagaagaagaaggtcaaataagggtttcagagctatgctggaaacagc

SEQ ID NO: 67466 - DNA, 70 bp, Artificial Sequence
  Synthetic
gccaagcatttaggtgacactatagacagaaaaactagccaggcggtttcagagctatgctggaaacagc

SEQ ID NO: 67467 - DNA, 70 bp, Artificial Sequence
  Synthetic
gccaagcatttaggtgacactatagtgactgaagtagtatcttacgtttcagagctatgctggaaacagc

SEQ ID NO: 67468 - DNA, 70 bp, Artificial Sequence
  Synthetic
gccaagcatttaggtgacactatagctgcactatgagctgtgacagtttcagagctatgctggaaacagc

SEQ ID NO: 67469 - DNA, 70 bp, Artificial Sequence
  Synthetic
gccaagcatttaggtgacactataggacactaaatcgcacgtagggtttcagagctatgctggaaacagc

SEQ ID NO: 67470 - DNA, 70 bp, Artificial Sequence
  Synthetic
gccaagcatttaggtgacactataggggactatcagtgctgcagcgtttcagagctatgctggaaacagc

SEQ ID NO: 67471 - DNA, 70 bp, Artificial Sequence
  Synthetic
gccaagcatttaggtgacactatagccatggaggcagagagataagtttcagagctatgctggaaacagc

SEQ ID NO: 67472 - DNA, 70 bp, Artificial Sequence
  Synthetic
gccaagcatttaggtgacactataggcggcgtccagtctcatctcgtttcagagctatgctggaaacagc

SEQ ID NO: 67473 - DNA, 70 bp, Artificial Sequence
  Synthetic
gccaagcatttaggtgacactatagaggcagggcctggtctcagcgtttcagagctatgctggaaacagc

SEQ ID NO: 67474 - DNA, 70 bp, Artificial Sequence
  Synthetic
gccaagcatttaggtgacactatagtggagtgcctccgtggtcacgtttcagagctatgctggaaacagc

SEQ ID NO: 67475 - DNA, 70 bp, Artificial Sequence
  Synthetic
gccaagcatttaggtgacactatagtgggtttagtttgtccagtagtttcagagctatgctggaaacagc

SEQ ID NO: 67476 - DNA, 70 bp, Artificial Sequence
  Synthetic
gccaagcatttaggtgacactatagaagagggtcagggcctcagtgtttcagagctatgctggaaacagc

SEQ ID NO: 67477 - DNA, 70 bp, Artificial Sequence
  Synthetic
gccaagcatttaggtgacactatagaatttcgtcgatgaccagctgtttcagagctatgctggaaacagc

SEQ ID NO: 67478 - DNA, 70 bp, Artificial Sequence
  Synthetic
gccaagcatttaggtgacactatagtggacggctgagagctaattgtttcagagctatgctggaaacagc

SEQ ID NO: 67479 - DNA, 70 bp, Artificial Sequence
  Synthetic
gccaagcatttaggtgacactatagaactggaggaactggatctcgtttcagagctatgctggaaacagc

SEQ ID NO: 67480 - DNA, 70 bp, Artificial Sequence
  Synthetic
gccaagcatttaggtgacactatagagaggaaggaaaatgggagtgtttcagagctatgctggaaacagc

SEQ ID NO: 67481 - DNA, 70 bp, Artificial Sequence
  Synthetic
gccaagcatttaggtgacactatagtgtggtttattcttgaagcagtttcagagctatgctggaaacagc

SEQ ID NO: 67482 - DNA, 70 bp, Artificial Sequence
  Synthetic
gccaagcatttaggtgacactatagctggtcctgcgcctgagggggtttcagagctatgctggaaacagc

SEQ ID NO: 67483 - DNA, 70 bp, Artificial Sequence
  Synthetic
gccaagcatttaggtgacactatagttggtcctgcgcttgagggggtttcagagctatgctggaaacagc

SEQ ID NO: 67484 - DNA, 70 bp, Artificial Sequence
  Synthetic
gccaagcatttaggtgacactatagtggcatgttattgtattggagtttcagagctatgctggaaacagc

SEQ ID NO: 67485 - DNA, 70 bp, Artificial Sequence
  Synthetic
gccaagcatttaggtgacactatagctgcaatagtagaacaaagcgtttcagagctatgctggaaacagc

SEQ ID NO: 67486 - DNA, 70 bp, Artificial Sequence
  Synthetic
gccaagcatttaggtgacactatagcggccattgttgaacaaagcgtttcagagctatgctggaaacagc

SEQ ID NO: 67487 - DNA, 70 bp, Artificial Sequence
  Synthetic
gccaagcatttaggtgacactataggcagcctgggtcagggctccgtttcagagctatgctggaaacagc

SEQ ID NO: 67488 - DNA, 70 bp, Artificial Sequence
  Synthetic
gccaagcatttaggtgacactatagtcggcagcatgtgtgttcaagtttcagagctatgctggaaacagc

SEQ ID NO: 67489 - DNA, 70 bp, Artificial Sequence
  Synthetic
gccaagcatttaggtgacactatagacaacagacatgcaagagaagtttcagagctatgctggaaacagc

SEQ ID NO: 67490 - DNA, 70 bp, Artificial Sequence
  Synthetic
gccaagcatttaggtgacactatagacaacagaatagctcgggaagtttcagagctatgctggaaacagc

SEQ ID NO: 67491 - DNA, 70 bp, Artificial Sequence
  Synthetic
gccaagcatttaggtgacactataggactttaaggtagcatcacagtttcagagctatgctggaaacagc

SEQ ID NO: 67492 - DNA, 70 bp, Artificial Sequence
  Synthetic
gccaagcatttaggtgacactatagagagaaatacgctatgttgtgtttcagagctatgctggaaacagc

SEQ ID NO: 67493 - DNA, 70 bp, Artificial Sequence
  Synthetic
gccaagcatttaggtgacactatagacaacagactagcaagagaggtttcagagctatgctggaaacagc

SEQ ID NO: 67494 - DNA, 70 bp, Artificial Sequence
  Synthetic
gccaagcatttaggtgacactataggtatctcttggtccactgtcgtttcagagctatgctggaaacagc

SEQ ID NO: 67495 - DNA, 70 bp, Artificial Sequence
  Synthetic
gccaagcatttaggtgacactataggcaggcagcaggcccctatggtttcagagctatgctggaaacagc

SEQ ID NO: 67496 - DNA, 70 bp, Artificial Sequence
  Synthetic
gccaagcatttaggtgacactatagaatcgtccccttttatcatcgtttcagagctatgctggaaacagc

SEQ ID NO: 67497 - DNA, 70 bp, Artificial Sequence
  Synthetic
gccaagcatttaggtgacactataggtcactcaaaagcagtctctgtttcagagctatgctggaaacagc

SEQ ID NO: 67498 - DNA, 70 bp, Artificial Sequence
  Synthetic
gccaagcatttaggtgacactatagcagatcgtccagaagtctctgtttcagagctatgctggaaacagc

SEQ ID NO: 67499 - DNA, 70 bp, Artificial Sequence
  Synthetic
gccaagcatttaggtgacactatagtctactacaactccatatccgtttcagagctatgctggaaacagc

SEQ ID NO: 67500 - DNA, 70 bp, Artificial Sequence
  Synthetic
gccaagcatttaggtgacactatagccacaaggtcgctgcttatggtttcagagctatgctggaaacagc

SEQ ID NO: 67501 - DNA, 70 bp, Artificial Sequence
  Synthetic
gccaagcatttaggtgacactatagcgtttgccagatatattcgtgtttcagagctatgctggaaacagc

SEQ ID NO: 67502 - DNA, 70 bp, Artificial Sequence
  Synthetic
gccaagcatttaggtgacactatagaggagcatcgcgcaggagtggtttcagagctatgctggaaacagc

SEQ ID NO: 67503 - DNA, 70 bp, Artificial Sequence
  Synthetic
gccaagcatttaggtgacactataggaattgcttctgagtaactggtttcagagctatgctggaaacagc

SEQ ID NO: 67504 - DNA, 70 bp, Artificial Sequence
  Synthetic
gccaagcatttaggtgacactatagcgtggcagattttagtccacgtttcagagctatgctggaaacagc

SEQ ID NO: 67505 - DNA, 70 bp, Artificial Sequence
  Synthetic
gccaagcatttaggtgacactataggggtcagaacatgagttagggtttcagagctatgctggaaacagc

SEQ ID NO: 67506 - DNA, 70 bp, Artificial Sequence
  Synthetic
gccaagcatttaggtgacactatagtttgagcgctgcctgaaatagtttcagagctatgctggaaacagc

SEQ ID NO: 67507 - DNA, 70 bp, Artificial Sequence
  Synthetic
gccaagcatttaggtgacactatagaaacagctagagcatggactgtttcagagctatgctggaaacagc

SEQ ID NO: 67508 - DNA, 70 bp, Artificial Sequence
  Synthetic
gccaagcatttaggtgacactatagaggcatgccggagtgcacaggtttcagagctatgctggaaacagc

SEQ ID NO: 67509 - DNA, 70 bp, Artificial Sequence
  Synthetic
gccaagcatttaggtgacactatagtacacacccccaaaagaagagtttcagagctatgctggaaacagc

SEQ ID NO: 67510 - DNA, 70 bp, Artificial Sequence
  Synthetic
gccaagcatttaggtgacactatagtacacccctccaaaggaagagtttcagagctatgctggaaacagc

SEQ ID NO: 67511 - DNA, 70 bp, Artificial Sequence
  Synthetic
gccaagcatttaggtgacactatagctaaggagaacagttcggtggtttcagagctatgctggaaacagc

SEQ ID NO: 67512 - DNA, 70 bp, Artificial Sequence
  Synthetic
gccaagcatttaggtgacactatagacgtggcagacatcagccgtgtttcagagctatgctggaaacagc

SEQ ID NO: 67513 - DNA, 70 bp, Artificial Sequence
  Synthetic
gccaagcatttaggtgacactatagtgatgatgattctgggaatggtttcagagctatgctggaaacagc

SEQ ID NO: 67514 - DNA, 70 bp, Artificial Sequence
  Synthetic
gccaagcatttaggtgacactatagggcgctgcggcggctgtagtgtttcagagctatgctggaaacagc

SEQ ID NO: 67515 - DNA, 70 bp, Artificial Sequence
  Synthetic
gccaagcatttaggtgacactatagggacaagtcccctaaacatcgtttcagagctatgctggaaacagc

SEQ ID NO: 67516 - DNA, 70 bp, Artificial Sequence
  Synthetic
gccaagcatttaggtgacactatagatctacagcatcagaaagaagtttcagagctatgctggaaacagc

SEQ ID NO: 67517 - DNA, 70 bp, Artificial Sequence
  Synthetic
gccaagcatttaggtgacactatagattgctgtaacactgtccttgtttcagagctatgctggaaacagc

SEQ ID NO: 67518 - DNA, 70 bp, Artificial Sequence
  Synthetic
gccaagcatttaggtgacactatagttggctggcattatgaagacgtttcagagctatgctggaaacagc

SEQ ID NO: 67519 - DNA, 70 bp, Artificial Sequence
  Synthetic
gccaagcatttaggtgacactatagttgttgtatgtttgtccttcgtttcagagctatgctggaaacagc

SEQ ID NO: 67520 - DNA, 70 bp, Artificial Sequence
  Synthetic
gccaagcatttaggtgacactatagtagcatgctttccagctgcagtttcagagctatgctggaaacagc

SEQ ID NO: 67521 - DNA, 70 bp, Artificial Sequence
  Synthetic
gccaagcatttaggtgacactatagggagcagggtctaaaccctcgtttcagagctatgctggaaacagc

SEQ ID NO: 67522 - DNA, 70 bp, Artificial Sequence
  Synthetic
gccaagcatttaggtgacactatagatcacgtatgccaaaggattgtttcagagctatgctggaaacagc

SEQ ID NO: 67523 - DNA, 70 bp, Artificial Sequence
  Synthetic
gccaagcatttaggtgacactatagactggcagttgtctcgctaggtttcagagctatgctggaaacagc

SEQ ID NO: 67524 - DNA, 70 bp, Artificial Sequence
  Synthetic
gccaagcatttaggtgacactatagtacgccatcagcatgaacacgtttcagagctatgctggaaacagc

SEQ ID NO: 67525 - DNA, 70 bp, Artificial Sequence
  Synthetic
gccaagcatttaggtgacactatagtcagctcagctcaaagccaggtttcagagctatgctggaaacagc

SEQ ID NO: 67526 - DNA, 70 bp, Artificial Sequence
  Synthetic
gccaagcatttaggtgacactatagtcgccgtgtgaattcctttcgtttcagagctatgctggaaacagc

SEQ ID NO: 67527 - DNA, 70 bp, Artificial Sequence
  Synthetic
gccaagcatttaggtgacactatagtgcagagaggaaacaacaaagtttcagagctatgctggaaacagc

SEQ ID NO: 67528 - DNA, 70 bp, Artificial Sequence
  Synthetic
gccaagcatttaggtgacactatagtgaaagagcagattcaggcggtttcagagctatgctggaaacagc

SEQ ID NO: 67529 - DNA, 70 bp, Artificial Sequence
  Synthetic
gccaagcatttaggtgacactatagaagacactgtgctggggaaagtttcagagctatgctggaaacagc

SEQ ID NO: 67530 - DNA, 70 bp, Artificial Sequence
  Synthetic
gccaagcatttaggtgacactatagatgtgggcactctgcttcaggtttcagagctatgctggaaacagc

SEQ ID NO: 67531 - DNA, 70 bp, Artificial Sequence
  Synthetic
gccaagcatttaggtgacactatagcagtctgcccaaaatttaaggtttcagagctatgctggaaacagc

SEQ ID NO: 67532 - DNA, 70 bp, Artificial Sequence
  Synthetic
gccaagcatttaggtgacactatagtctgcttcagtggctagatggtttcagagctatgctggaaacagc

SEQ ID NO: 67533 - DNA, 70 bp, Artificial Sequence
  Synthetic
gccaagcatttaggtgacactatagactaggcagacagtgtttacgtttcagagctatgctggaaacagc

SEQ ID NO: 67534 - DNA, 70 bp, Artificial Sequence
  Synthetic
gccaagcatttaggtgacactatagcatgctccgagaattctattgtttcagagctatgctggaaacagc

SEQ ID NO: 67535 - DNA, 70 bp, Artificial Sequence
  Synthetic
gccaagcatttaggtgacactataggcagcagctgatcagtaaacgtttcagagctatgctggaaacagc

SEQ ID NO: 67536 - DNA, 70 bp, Artificial Sequence
  Synthetic
gccaagcatttaggtgacactatagaatccacgatgggatgaaccgtttcagagctatgctggaaacagc

SEQ ID NO: 67537 - DNA, 70 bp, Artificial Sequence
  Synthetic
gccaagcatttaggtgacactatagaggggaagcagggagttcatgtttcagagctatgctggaaacagc

SEQ ID NO: 67538 - DNA, 70 bp, Artificial Sequence
  Synthetic
gccaagcatttaggtgacactatagagatatctctcaaagaagcagtttcagagctatgctggaaacagc

SEQ ID NO: 67539 - DNA, 70 bp, Artificial Sequence
  Synthetic
gccaagcatttaggtgacactatagtgaagcggtcacaatttccggtttcagagctatgctggaaacagc

SEQ ID NO: 67540 - DNA, 70 bp, Artificial Sequence
  Synthetic
gccaagcatttaggtgacactatagggcagtcactgagatttccggtttcagagctatgctggaaacagc

SEQ ID NO: 67541 - DNA, 70 bp, Artificial Sequence
  Synthetic
gccaagcatttaggtgacactatagggaggtcagtcactcagaaggtttcagagctatgctggaaacagc

SEQ ID NO: 67542 - DNA, 70 bp, Artificial Sequence
  Synthetic
gccaagcatttaggtgacactataggggagcgttgcttctcacccgtttcagagctatgctggaaacagc

SEQ ID NO: 67543 - DNA, 70 bp, Artificial Sequence
  Synthetic
gccaagcatttaggtgacactatagaacaagaatgtgaataccgggtttcagagctatgctggaaacagc

SEQ ID NO: 67544 - DNA, 70 bp, Artificial Sequence
  Synthetic
gccaagcatttaggtgacactatagatacagaaatgctgctatgagtttcagagctatgctggaaacagc

SEQ ID NO: 67545 - DNA, 70 bp, Artificial Sequence
  Synthetic
gccaagcatttaggtgacactatagagaaatgtgattacgatggcgtttcagagctatgctggaaacagc

SEQ ID NO: 67546 - DNA, 70 bp, Artificial Sequence
  Synthetic
gccaagcatttaggtgacactatagggagaagctgagacagtcgtgtttcagagctatgctggaaacagc

SEQ ID NO: 67547 - DNA, 70 bp, Artificial Sequence
  Synthetic
gccaagcatttaggtgacactatagggccgagggattaggagagcgtttcagagctatgctggaaacagc

SEQ ID NO: 67548 - DNA, 70 bp, Artificial Sequence
  Synthetic
gccaagcatttaggtgacactatagttctgatctgcttagtgcttgtttcagagctatgctggaaacagc

SEQ ID NO: 67549 - DNA, 70 bp, Artificial Sequence
  Synthetic
gccaagcatttaggtgacactatagatcggaagctccatttggtcgtttcagagctatgctggaaacagc

SEQ ID NO: 67550 - DNA, 70 bp, Artificial Sequence
  Synthetic
gccaagcatttaggtgacactatagtgccttggctaggattacaggtttcagagctatgctggaaacagc

SEQ ID NO: 67551 - DNA, 70 bp, Artificial Sequence
  Synthetic
gccaagcatttaggtgacactatagagacactggttggcattgacgtttcagagctatgctggaaacagc

SEQ ID NO: 67552 - DNA, 70 bp, Artificial Sequence
  Synthetic
gccaagcatttaggtgacactataggatggggtccacattacaatgtttcagagctatgctggaaacagc

SEQ ID NO: 67553 - DNA, 70 bp, Artificial Sequence
  Synthetic
gccaagcatttaggtgacactatagagctgctgtgtggtggtcaggtttcagagctatgctggaaacagc

SEQ ID NO: 67554 - DNA, 70 bp, Artificial Sequence
  Synthetic
gccaagcatttaggtgacactatagatctgtttagaggaatagaggtttcagagctatgctggaaacagc

SEQ ID NO: 67555 - DNA, 70 bp, Artificial Sequence
  Synthetic
gccaagcatttaggtgacactatagcagtattactgcagctagaggtttcagagctatgctggaaacagc

SEQ ID NO: 67556 - DNA, 70 bp, Artificial Sequence
  Synthetic
gccaagcatttaggtgacactatagcccaccaccccaggactgatgtttcagagctatgctggaaacagc

SEQ ID NO: 67557 - DNA, 70 bp, Artificial Sequence
  Synthetic
gccaagcatttaggtgacactatagggctcagttcagttctccacgtttcagagctatgctggaaacagc

SEQ ID NO: 67558 - DNA, 70 bp, Artificial Sequence
  Synthetic
gccaagcatttaggtgacactataggggtggggctgagcctcagtgtttcagagctatgctggaaacagc

SEQ ID NO: 67559 - DNA, 70 bp, Artificial Sequence
  Synthetic
gccaagcatttaggtgacactatagaactcttcagactgcagcaggtttcagagctatgctggaaacagc

SEQ ID NO: 67560 - DNA, 70 bp, Artificial Sequence
  Synthetic
gccaagcatttaggtgacactatagaggagggatgcaaagagaaggtttcagagctatgctggaaacagc

SEQ ID NO: 67561 - DNA, 70 bp, Artificial Sequence
  Synthetic
gccaagcatttaggtgacactatagatgggacaaaggccctcagcgtttcagagctatgctggaaacagc

SEQ ID NO: 67562 - DNA, 70 bp, Artificial Sequence
  Synthetic
gccaagcatttaggtgacactatagcactggaagatggggaaggggtttcagagctatgctggaaacagc

SEQ ID NO: 67563 - DNA, 70 bp, Artificial Sequence
  Synthetic
gccaagcatttaggtgacactatagtgagggggcgggtgctttatgtttcagagctatgctggaaacagc

SEQ ID NO: 67564 - DNA, 70 bp, Artificial Sequence
  Synthetic
gccaagcatttaggtgacactataggctagatgagacactcacacgtttcagagctatgctggaaacagc

SEQ ID NO: 67565 - DNA, 70 bp, Artificial Sequence
  Synthetic
gccaagcatttaggtgacactatagtatctgcttctagcagtgtcgtttcagagctatgctggaaacagc

SEQ ID NO: 67566 - DNA, 70 bp, Artificial Sequence
  Synthetic
gccaagcatttaggtgacactatagttctggagtctgttaagagagtttcagagctatgctggaaacagc

SEQ ID NO: 67567 - DNA, 70 bp, Artificial Sequence
  Synthetic
gccaagcatttaggtgacactataggtcacactacatctgttgaggtttcagagctatgctggaaacagc

SEQ ID NO: 67568 - DNA, 70 bp, Artificial Sequence
  Synthetic
gccaagcatttaggtgacactatagatttcacaagagcttctcgagtttcagagctatgctggaaacagc

SEQ ID NO: 67569 - DNA, 70 bp, Artificial Sequence
  Synthetic
gccaagcatttaggtgacactatagtcaagagactgtctttgtacgtttcagagctatgctggaaacagc

SEQ ID NO: 67570 - DNA, 70 bp, Artificial Sequence
  Synthetic
gccaagcatttaggtgacactataggctctcccttctttcctagtgtttcagagctatgctggaaacagc

SEQ ID NO: 67571 - DNA, 70 bp, Artificial Sequence
  Synthetic
gccaagcatttaggtgacactatagctctgccgtggctctctgcagtttcagagctatgctggaaacagc

SEQ ID NO: 67572 - DNA, 70 bp, Artificial Sequence
  Synthetic
gccaagcatttaggtgacactatagtttcatcactagtttcaccagtttcagagctatgctggaaacagc

SEQ ID NO: 67573 - DNA, 70 bp, Artificial Sequence
  Synthetic
gccaagcatttaggtgacactatagacagaacgcaaagaaagctcgtttcagagctatgctggaaacagc

SEQ ID NO: 67574 - DNA, 70 bp, Artificial Sequence
  Synthetic
gccaagcatttaggtgacactatagcactttgagaagacactactgtttcagagctatgctggaaacagc

SEQ ID NO: 67575 - DNA, 70 bp, Artificial Sequence
  Synthetic
gccaagcatttaggtgacactatagctactagtggtattaactgcgtttcagagctatgctggaaacagc

SEQ ID NO: 67576 - DNA, 70 bp, Artificial Sequence
  Synthetic
gccaagcatttaggtgacactataggaggctcggcagcccctcaggtttcagagctatgctggaaacagc

SEQ ID NO: 67577 - DNA, 70 bp, Artificial Sequence
  Synthetic
gccaagcatttaggtgacactatagcacatccaggacattctgaagtttcagagctatgctggaaacagc

SEQ ID NO: 67578 - DNA, 70 bp, Artificial Sequence
  Synthetic
gccaagcatttaggtgacactatagccgatggagacgggtcaatggtttcagagctatgctggaaacagc

SEQ ID NO: 67579 - DNA, 70 bp, Artificial Sequence
  Synthetic
gccaagcatttaggtgacactatagactgggcagctaacccgtgtgtttcagagctatgctggaaacagc

SEQ ID NO: 67580 - DNA, 70 bp, Artificial Sequence
  Synthetic
gccaagcatttaggtgacactatagtctttgcagaccatcttctggtttcagagctatgctggaaacagc

SEQ ID NO: 67581 - DNA, 70 bp, Artificial Sequence
  Synthetic
gccaagcatttaggtgacactatagtcgactcggtgggcaagtgagtttcagagctatgctggaaacagc

SEQ ID NO: 67582 - DNA, 70 bp, Artificial Sequence
  Synthetic
gccaagcatttaggtgacactataggacaaggctgccatggtcacgtttcagagctatgctggaaacagc

SEQ ID NO: 67583 - DNA, 70 bp, Artificial Sequence
  Synthetic
gccaagcatttaggtgacactatagaaattgggaggaagaagtaggtttcagagctatgctggaaacagc

SEQ ID NO: 67584 - DNA, 70 bp, Artificial Sequence
  Synthetic
gccaagcatttaggtgacactataggtcaaagtcaaggcagactagtttcagagctatgctggaaacagc

SEQ ID NO: 67585 - DNA, 70 bp, Artificial Sequence
  Synthetic
gccaagcatttaggtgacactatagagcagcaggagaggctcagagtttcagagctatgctggaaacagc

SEQ ID NO: 67586 - DNA, 70 bp, Artificial Sequence
  Synthetic
gccaagcatttaggtgacactataggatgaaagtccagatgttacgtttcagagctatgctggaaacagc

SEQ ID NO: 67587 - DNA, 70 bp, Artificial Sequence
  Synthetic
gccaagcatttaggtgacactataggccccacagccttctacaaggtttcagagctatgctggaaacagc

SEQ ID NO: 67588 - DNA, 70 bp, Artificial Sequence
  Synthetic
gccaagcatttaggtgacactatagttacccaggctggagtgtaggtttcagagctatgctggaaacagc

SEQ ID NO: 67589 - DNA, 70 bp, Artificial Sequence
  Synthetic
gccaagcatttaggtgacactatagctcaagtgcagctgtccaacgtttcagagctatgctggaaacagc

SEQ ID NO: 67590 - DNA, 70 bp, Artificial Sequence
  Synthetic
gccaagcatttaggtgacactatagggcgagcaaggagaagacaagtttcagagctatgctggaaacagc

SEQ ID NO: 67591 - DNA, 70 bp, Artificial Sequence
  Synthetic
gccaagcatttaggtgacactatagttaactgttgttggagactggtttcagagctatgctggaaacagc

SEQ ID NO: 67592 - DNA, 70 bp, Artificial Sequence
  Synthetic
gccaagcatttaggtgacactatagtcagtggcttgattcttcatgtttcagagctatgctggaaacagc

SEQ ID NO: 67593 - DNA, 70 bp, Artificial Sequence
  Synthetic
gccaagcatttaggtgacactatagagcccctccccaatcaagccgtttcagagctatgctggaaacagc

SEQ ID NO: 67594 - DNA, 70 bp, Artificial Sequence
  Synthetic
gccaagcatttaggtgacactatagggacagtcattgcgtaaaaagtttcagagctatgctggaaacagc

SEQ ID NO: 67595 - DNA, 70 bp, Artificial Sequence
  Synthetic
gccaagcatttaggtgacactatagatctaggaaatcatctgtgagtttcagagctatgctggaaacagc

SEQ ID NO: 67596 - DNA, 70 bp, Artificial Sequence
  Synthetic
gccaagcatttaggtgacactatagagatactgatttcttccggagtttcagagctatgctggaaacagc

SEQ ID NO: 67597 - DNA, 70 bp, Artificial Sequence
  Synthetic
gccaagcatttaggtgacactatagattattcctagagatcgtgtgtttcagagctatgctggaaacagc

SEQ ID NO: 67598 - DNA, 70 bp, Artificial Sequence
  Synthetic
gccaagcatttaggtgacactatagcagcagcgcaccttggactggtttcagagctatgctggaaacagc

SEQ ID NO: 67599 - DNA, 70 bp, Artificial Sequence
  Synthetic
gccaagcatttaggtgacactatagtaaatcatatttggtcgctggtttcagagctatgctggaaacagc

SEQ ID NO: 67600 - DNA, 70 bp, Artificial Sequence
  Synthetic
gccaagcatttaggtgacactatagacgctgtgggggtacagcaggtttcagagctatgctggaaacagc

SEQ ID NO: 67601 - DNA, 70 bp, Artificial Sequence
  Synthetic
gccaagcatttaggtgacactatagaatggcaatctctacactttgtttcagagctatgctggaaacagc

SEQ ID NO: 67602 - DNA, 70 bp, Artificial Sequence
  Synthetic
gccaagcatttaggtgacactatagacaaaagaaccaagccgagagtttcagagctatgctggaaacagc

SEQ ID NO: 67603 - DNA, 70 bp, Artificial Sequence
  Synthetic
gccaagcatttaggtgacactatagcagaattgtcccagaatggggtttcagagctatgctggaaacagc

SEQ ID NO: 67604 - DNA, 70 bp, Artificial Sequence
  Synthetic
gccaagcatttaggtgacactataggtctggaaaccttcgcatctgtttcagagctatgctggaaacagc

SEQ ID NO: 67605 - DNA, 70 bp, Artificial Sequence
  Synthetic
gccaagcatttaggtgacactatagatttcccacccacttctcaagtttcagagctatgctggaaacagc

SEQ ID NO: 67606 - DNA, 70 bp, Artificial Sequence
  Synthetic
gccaagcatttaggtgacactatagtgtgacaacggctatattttgtttcagagctatgctggaaacagc

SEQ ID NO: 67607 - DNA, 70 bp, Artificial Sequence
  Synthetic
gccaagcatttaggtgacactataggaatatagcagttgccacacgtttcagagctatgctggaaacagc

SEQ ID NO: 67608 - DNA, 70 bp, Artificial Sequence
  Synthetic
gccaagcatttaggtgacactatagttctggaagtttgctagaaagtttcagagctatgctggaaacagc

SEQ ID NO: 67609 - DNA, 70 bp, Artificial Sequence
  Synthetic
gccaagcatttaggtgacactatagtttgctagaaaagggaagaagtttcagagctatgctggaaacagc

SEQ ID NO: 67610 - DNA, 70 bp, Artificial Sequence
  Synthetic
gccaagcatttaggtgacactatagttccgaaagcttgccaaaaagtttcagagctatgctggaaacagc

SEQ ID NO: 67611 - DNA, 70 bp, Artificial Sequence
  Synthetic
gccaagcatttaggtgacactatagttccgaaagcttgccaaaacgtttcagagctatgctggaaacagc

SEQ ID NO: 67612 - DNA, 70 bp, Artificial Sequence
  Synthetic
gccaagcatttaggtgacactatagcttttgtgggatcttggcaagtttcagagctatgctggaaacagc

SEQ ID NO: 67613 - DNA, 70 bp, Artificial Sequence
  Synthetic
gccaagcatttaggtgacactatagtcaatactcggctgtacaaggtttcagagctatgctggaaacagc

SEQ ID NO: 67614 - DNA, 70 bp, Artificial Sequence
  Synthetic
gccaagcatttaggtgacactatagttgttagaacaggaaagaaggtttcagagctatgctggaaacagc

SEQ ID NO: 67615 - DNA, 70 bp, Artificial Sequence
  Synthetic
gccaagcatttaggtgacactatagtcaatactcggctctacaaggtttcagagctatgctggaaacagc

SEQ ID NO: 67616 - DNA, 70 bp, Artificial Sequence
  Synthetic
gccaagcatttaggtgacactatagtgggttcctgctggtctgtggtttcagagctatgctggaaacagc

SEQ ID NO: 67617 - DNA, 70 bp, Artificial Sequence
  Synthetic
gccaagcatttaggtgacactatagaggaaggtgaagaagacatggtttcagagctatgctggaaacagc

SEQ ID NO: 67618 - DNA, 70 bp, Artificial Sequence
  Synthetic
gccaagcatttaggtgacactatagtgtatcctgaaccactgagagtttcagagctatgctggaaacagc

SEQ ID NO: 67619 - DNA, 70 bp, Artificial Sequence
  Synthetic
gccaagcatttaggtgacactatagagaaaggtgaaggagacatagtttcagagctatgctggaaacagc

SEQ ID NO: 67620 - DNA, 70 bp, Artificial Sequence
  Synthetic
gccaagcatttaggtgacactatagttcttttgtacttgccattggtttcagagctatgctggaaacagc

SEQ ID NO: 67621 - DNA, 70 bp, Artificial Sequence
  Synthetic
gccaagcatttaggtgacactatagccgctgagtgcctacaagaggtttcagagctatgctggaaacagc

SEQ ID NO: 67622 - DNA, 70 bp, Artificial Sequence
  Synthetic
gccaagcatttaggtgacactataggctaagactgctgaatgtgcgtttcagagctatgctggaaacagc

SEQ ID NO: 67623 - DNA, 70 bp, Artificial Sequence
  Synthetic
gccaagcatttaggtgacactataggagaagtgcttggagatcacgtttcagagctatgctggaaacagc

SEQ ID NO: 67624 - DNA, 70 bp, Artificial Sequence
  Synthetic
gccaagcatttaggtgacactatagctggtttcagagctcaaagagtttcagagctatgctggaaacagc

SEQ ID NO: 67625 - DNA, 70 bp, Artificial Sequence
  Synthetic
gccaagcatttaggtgacactataggaagatgacagttgaatagcgtttcagagctatgctggaaacagc

SEQ ID NO: 67626 - DNA, 70 bp, Artificial Sequence
  Synthetic
gccaagcatttaggtgacactatagttgagttttctcatctgcttgtttcagagctatgctggaaacagc

SEQ ID NO: 67627 - DNA, 70 bp, Artificial Sequence
  Synthetic
gccaagcatttaggtgacactatagttcttccctggctacagcaagtttcagagctatgctggaaacagc

SEQ ID NO: 67628 - DNA, 70 bp, Artificial Sequence
  Synthetic
gccaagcatttaggtgacactatagccaaagctggcagaggaagagtttcagagctatgctggaaacagc

SEQ ID NO: 67629 - DNA, 70 bp, Artificial Sequence
  Synthetic
gccaagcatttaggtgacactataggcaaacttgttcagccactagtttcagagctatgctggaaacagc

SEQ ID NO: 67630 - DNA, 70 bp, Artificial Sequence
  Synthetic
gccaagcatttaggtgacactatagttcattctagctggcagatggtttcagagctatgctggaaacagc

SEQ ID NO: 67631 - DNA, 70 bp, Artificial Sequence
  Synthetic
gccaagcatttaggtgacactatagttcatcctccctggcatctggtttcagagctatgctggaaacagc

SEQ ID NO: 67632 - DNA, 70 bp, Artificial Sequence
  Synthetic
gccaagcatttaggtgacactatagaatgactcttctcagatgccgtttcagagctatgctggaaacagc

SEQ ID NO: 67633 - DNA, 70 bp, Artificial Sequence
  Synthetic
gccaagcatttaggtgacactatagagactctcggcgctgctgacgtttcagagctatgctggaaacagc

SEQ ID NO: 67634 - DNA, 70 bp, Artificial Sequence
  Synthetic
gccaagcatttaggtgacactatagggatgagcctgctgctcacagtttcagagctatgctggaaacagc

SEQ ID NO: 67635 - DNA, 70 bp, Artificial Sequence
  Synthetic
gccaagcatttaggtgacactatagcattcttctagggtcactgagtttcagagctatgctggaaacagc

SEQ ID NO: 67636 - DNA, 70 bp, Artificial Sequence
  Synthetic
gccaagcatttaggtgacactatagaggagcagaagcttctgttagtttcagagctatgctggaaacagc

SEQ ID NO: 67637 - DNA, 70 bp, Artificial Sequence
  Synthetic
gccaagcatttaggtgacactatagcctccaagccgttgggcactgtttcagagctatgctggaaacagc

SEQ ID NO: 67638 - DNA, 70 bp, Artificial Sequence
  Synthetic
gccaagcatttaggtgacactataggcgaaaacttatcacggtttgtttcagagctatgctggaaacagc

SEQ ID NO: 67639 - DNA, 70 bp, Artificial Sequence
  Synthetic
gccaagcatttaggtgacactatagctgtcagtcactgaaaagtcgtttcagagctatgctggaaacagc

SEQ ID NO: 67640 - DNA, 70 bp, Artificial Sequence
  Synthetic
gccaagcatttaggtgacactatagccaggtgttctacgaatagggtttcagagctatgctggaaacagc

SEQ ID NO: 67641 - DNA, 70 bp, Artificial Sequence
  Synthetic
gccaagcatttaggtgacactataggaagcgtatttgagtagactgtttcagagctatgctggaaacagc

SEQ ID NO: 67642 - DNA, 70 bp, Artificial Sequence
  Synthetic
gccaagcatttaggtgacactataggggtcagggtgtcccgctgtgtttcagagctatgctggaaacagc

SEQ ID NO: 67643 - DNA, 70 bp, Artificial Sequence
  Synthetic
gccaagcatttaggtgacactatagtggctcccacctgcctcagggtttcagagctatgctggaaacagc

SEQ ID NO: 67644 - DNA, 70 bp, Artificial Sequence
  Synthetic
gccaagcatttaggtgacactatagttctgggagtggggaagtgggtttcagagctatgctggaaacagc

SEQ ID NO: 67645 - DNA, 70 bp, Artificial Sequence
  Synthetic
gccaagcatttaggtgacactatagtctactcttgcagcacttacgtttcagagctatgctggaaacagc

SEQ ID NO: 67646 - DNA, 70 bp, Artificial Sequence
  Synthetic
gccaagcatttaggtgacactataggccgcgcctgcgccttagcggtttcagagctatgctggaaacagc

SEQ ID NO: 67647 - DNA, 70 bp, Artificial Sequence
  Synthetic
gccaagcatttaggtgacactatagagtctcgttccacggaggaggtttcagagctatgctggaaacagc

SEQ ID NO: 67648 - DNA, 70 bp, Artificial Sequence
  Synthetic
gccaagcatttaggtgacactatagtcagaggaccagtgatgatggtttcagagctatgctggaaacagc

SEQ ID NO: 67649 - DNA, 70 bp, Artificial Sequence
  Synthetic
gccaagcatttaggtgacactatagaacctctacggctacggtgcgtttcagagctatgctggaaacagc

SEQ ID NO: 67650 - DNA, 70 bp, Artificial Sequence
  Synthetic
gccaagcatttaggtgacactatagaaccaagatggagagtgagggtttcagagctatgctggaaacagc

SEQ ID NO: 67651 - DNA, 70 bp, Artificial Sequence
  Synthetic
gccaagcatttaggtgacactatagagggtcgctgtctaagacacgtttcagagctatgctggaaacagc

SEQ ID NO: 67652 - DNA, 70 bp, Artificial Sequence
  Synthetic
gccaagcatttaggtgacactatagggctttccctggcactgggagtttcagagctatgctggaaacagc

SEQ ID NO: 67653 - DNA, 70 bp, Artificial Sequence
  Synthetic
gccaagcatttaggtgacactataggtgtcggaggctgagtgctggtttcagagctatgctggaaacagc

SEQ ID NO: 67654 - DNA, 70 bp, Artificial Sequence
  Synthetic
gccaagcatttaggtgacactatagggaggctcagcagtccccgtgtttcagagctatgctggaaacagc

SEQ ID NO: 67655 - DNA, 70 bp, Artificial Sequence
  Synthetic
gccaagcatttaggtgacactatagtggtgtccttagcagcagaagtttcagagctatgctggaaacagc

SEQ ID NO: 67656 - DNA, 70 bp, Artificial Sequence
  Synthetic
gccaagcatttaggtgacactatagagagcttctcgtccagctccgtttcagagctatgctggaaacagc

SEQ ID NO: 67657 - DNA, 70 bp, Artificial Sequence
  Synthetic
gccaagcatttaggtgacactatagttcaactacagcaggcaaaagtttcagagctatgctggaaacagc

SEQ ID NO: 67658 - DNA, 70 bp, Artificial Sequence
  Synthetic
gccaagcatttaggtgacactataggccgaggagtccactcataggtttcagagctatgctggaaacagc

SEQ ID NO: 67659 - DNA, 70 bp, Artificial Sequence
  Synthetic
gccaagcatttaggtgacactatagtcccactgagctggggaaaagtttcagagctatgctggaaacagc

SEQ ID NO: 67660 - DNA, 70 bp, Artificial Sequence
  Synthetic
gccaagcatttaggtgacactataggtatttcttcatcctctgccgtttcagagctatgctggaaacagc

SEQ ID NO: 67661 - DNA, 70 bp, Artificial Sequence
  Synthetic
gccaagcatttaggtgacactatagcgggccggaggagcagtgaggtttcagagctatgctggaaacagc

SEQ ID NO: 67662 - DNA, 70 bp, Artificial Sequence
  Synthetic
gccaagcatttaggtgacactataggaggagctggacatggactggtttcagagctatgctggaaacagc

SEQ ID NO: 67663 - DNA, 70 bp, Artificial Sequence
  Synthetic
gccaagcatttaggtgacactatagcaagaagcccattgactggagtttcagagctatgctggaaacagc

SEQ ID NO: 67664 - DNA, 70 bp, Artificial Sequence
  Synthetic
gccaagcatttaggtgacactatagcaggcctgcagggtcacgacgtttcagagctatgctggaaacagc

SEQ ID NO: 67665 - DNA, 70 bp, Artificial Sequence
  Synthetic
gccaagcatttaggtgacactatagcccgctgaggtcaccactgcgtttcagagctatgctggaaacagc

SEQ ID NO: 67666 - DNA, 70 bp, Artificial Sequence
  Synthetic
gccaagcatttaggtgacactatagggggacagctggggctcagggtttcagagctatgctggaaacagc

SEQ ID NO: 67667 - DNA, 70 bp, Artificial Sequence
  Synthetic
gccaagcatttaggtgacactatagcaccatcgtgaaagagtagcgtttcagagctatgctggaaacagc

SEQ ID NO: 67668 - DNA, 70 bp, Artificial Sequence
  Synthetic
gccaagcatttaggtgacactatagggggctgtcccagtattaaagtttcagagctatgctggaaacagc

SEQ ID NO: 67669 - DNA, 70 bp, Artificial Sequence
  Synthetic
gccaagcatttaggtgacactatagtaatctttaagactggtggggtttcagagctatgctggaaacagc

SEQ ID NO: 67670 - DNA, 70 bp, Artificial Sequence
  Synthetic
gccaagcatttaggtgacactatagtggtcctgagaagagggaaggtttcagagctatgctggaaacagc

SEQ ID NO: 67671 - DNA, 70 bp, Artificial Sequence
  Synthetic
gccaagcatttaggtgacactatagcttattccttaccaggaaacgtttcagagctatgctggaaacagc

SEQ ID NO: 67672 - DNA, 70 bp, Artificial Sequence
  Synthetic
gccaagcatttaggtgacactatagaaagaaacgtttgcgggaaggtttcagagctatgctggaaacagc

SEQ ID NO: 67673 - DNA, 70 bp, Artificial Sequence
  Synthetic
gccaagcatttaggtgacactataggcgaagacaagagagctcatgtttcagagctatgctggaaacagc

SEQ ID NO: 67674 - DNA, 70 bp, Artificial Sequence
  Synthetic
gccaagcatttaggtgacactatagtatagttccagctactgagggtttcagagctatgctggaaacagc

SEQ ID NO: 67675 - DNA, 70 bp, Artificial Sequence
  Synthetic
gccaagcatttaggtgacactatagttatattctggatctcaggtgtttcagagctatgctggaaacagc

SEQ ID NO: 67676 - DNA, 70 bp, Artificial Sequence
  Synthetic
gccaagcatttaggtgacactatagccatagaaaagaaggaggaggtttcagagctatgctggaaacagc

SEQ ID NO: 67677 - DNA, 70 bp, Artificial Sequence
  Synthetic
gccaagcatttaggtgacactatagatttctacaccatgctctgagtttcagagctatgctggaaacagc

SEQ ID NO: 67678 - DNA, 70 bp, Artificial Sequence
  Synthetic
gccaagcatttaggtgacactatagttgggtttgccatcctgatggtttcagagctatgctggaaacagc

SEQ ID NO: 67679 - DNA, 70 bp, Artificial Sequence
  Synthetic
gccaagcatttaggtgacactatagtcctgggtaccatgttctacgtttcagagctatgctggaaacagc

SEQ ID NO: 67680 - DNA, 70 bp, Artificial Sequence
  Synthetic
gccaagcatttaggtgacactatagctgggctcccgcaagtaagggtttcagagctatgctggaaacagc

SEQ ID NO: 67681 - DNA, 70 bp, Artificial Sequence
  Synthetic
gccaagcatttaggtgacactatagggtggtgctgggctcagtctgtttcagagctatgctggaaacagc

SEQ ID NO: 67682 - DNA, 70 bp, Artificial Sequence
  Synthetic
gccaagcatttaggtgacactatagcccagcctcagcccctagccgtttcagagctatgctggaaacagc

SEQ ID NO: 67683 - DNA, 70 bp, Artificial Sequence
  Synthetic
gccaagcatttaggtgacactatagggctgggggagatggggcgcgtttcagagctatgctggaaacagc

SEQ ID NO: 67684 - DNA, 70 bp, Artificial Sequence
  Synthetic
gccaagcatttaggtgacactatagtgccgagggggcttcctgaggtttcagagctatgctggaaacagc

SEQ ID NO: 67685 - DNA, 70 bp, Artificial Sequence
  Synthetic
gccaagcatttaggtgacactatagcatcaagaagaaactgagcagtttcagagctatgctggaaacagc

SEQ ID NO: 67686 - DNA, 70 bp, Artificial Sequence
  Synthetic
gccaagcatttaggtgacactatagaacttcatcagacggcggctgtttcagagctatgctggaaacagc

SEQ ID NO: 67687 - DNA, 70 bp, Artificial Sequence
  Synthetic
gccaagcatttaggtgacactatagcctgttgcacctacacatttgtttcagagctatgctggaaacagc

SEQ ID NO: 67688 - DNA, 70 bp, Artificial Sequence
  Synthetic
gccaagcatttaggtgacactatagttcagcatgaggcagtaactgtttcagagctatgctggaaacagc

SEQ ID NO: 67689 - DNA, 70 bp, Artificial Sequence
  Synthetic
gccaagcatttaggtgacactatagcaacgacgagggactttgatgtttcagagctatgctggaaacagc

SEQ ID NO: 67690 - DNA, 70 bp, Artificial Sequence
  Synthetic
gccaagcatttaggtgacactataggggtcctgaggaggatcatagtttcagagctatgctggaaacagc

SEQ ID NO: 67691 - DNA, 70 bp, Artificial Sequence
  Synthetic
gccaagcatttaggtgacactataggtctcacggtgacctcccgcgtttcagagctatgctggaaacagc

SEQ ID NO: 67692 - DNA, 70 bp, Artificial Sequence
  Synthetic
gccaagcatttaggtgacactatagtatgtttagtcagcatgctcgtttcagagctatgctggaaacagc

SEQ ID NO: 67693 - DNA, 70 bp, Artificial Sequence
  Synthetic
gccaagcatttaggtgacactatagccaccagcatgatcaacatcgtttcagagctatgctggaaacagc

SEQ ID NO: 67694 - DNA, 70 bp, Artificial Sequence
  Synthetic
gccaagcatttaggtgacactataggggacagtatcagagagggagtttcagagctatgctggaaacagc

SEQ ID NO: 67695 - DNA, 70 bp, Artificial Sequence
  Synthetic
gccaagcatttaggtgacactatagcctctttcagatacggttcagtttcagagctatgctggaaacagc

SEQ ID NO: 67696 - DNA, 70 bp, Artificial Sequence
  Synthetic
gccaagcatttaggtgacactatagccttgaaccgtatctgaaaggtttcagagctatgctggaaacagc

SEQ ID NO: 67697 - DNA, 70 bp, Artificial Sequence
  Synthetic
gccaagcatttaggtgacactatagttctggctgcgcttctaggcgtttcagagctatgctggaaacagc

SEQ ID NO: 67698 - DNA, 70 bp, Artificial Sequence
  Synthetic
gccaagcatttaggtgacactatagatggcagcaagtggaaatttgtttcagagctatgctggaaacagc

SEQ ID NO: 67699 - DNA, 70 bp, Artificial Sequence
  Synthetic
gccaagcatttaggtgacactatagagtgacgatatggtgattgtgtttcagagctatgctggaaacagc

SEQ ID NO: 67700 - DNA, 70 bp, Artificial Sequence
  Synthetic
gccaagcatttaggtgacactatagcacagagctctagccgctccgtttcagagctatgctggaaacagc

SEQ ID NO: 67701 - DNA, 70 bp, Artificial Sequence
  Synthetic
gccaagcatttaggtgacactatagagagtttgtgggccacgcaagtttcagagctatgctggaaacagc

SEQ ID NO: 67702 - DNA, 70 bp, Artificial Sequence
  Synthetic
gccaagcatttaggtgacactatagggcgtaagccatggtgctctgtttcagagctatgctggaaacagc

SEQ ID NO: 67703 - DNA, 70 bp, Artificial Sequence
  Synthetic
gccaagcatttaggtgacactatagacagcttggcggggtctgcggtttcagagctatgctggaaacagc

SEQ ID NO: 67704 - DNA, 70 bp, Artificial Sequence
  Synthetic
gccaagcatttaggtgacactatagcggcaggagtcaagcatctggtttcagagctatgctggaaacagc

SEQ ID NO: 67705 - DNA, 70 bp, Artificial Sequence
  Synthetic
gccaagcatttaggtgacactataggagaaaagatatacggcctagtttcagagctatgctggaaacagc

SEQ ID NO: 67706 - DNA, 70 bp, Artificial Sequence
  Synthetic
gccaagcatttaggtgacactatagagctcattgagctggtgagagtttcagagctatgctggaaacagc

SEQ ID NO: 67707 - DNA, 70 bp, Artificial Sequence
  Synthetic
gccaagcatttaggtgacactatagaaaaaaggggattgttctaggtttcagagctatgctggaaacagc

SEQ ID NO: 67708 - DNA, 70 bp, Artificial Sequence
  Synthetic
gccaagcatttaggtgacactatagcagattgcaacagaaagactgtttcagagctatgctggaaacagc

SEQ ID NO: 67709 - DNA, 70 bp, Artificial Sequence
  Synthetic
gccaagcatttaggtgacactatagttacagtatgacattcagaggtttcagagctatgctggaaacagc

SEQ ID NO: 67710 - DNA, 70 bp, Artificial Sequence
  Synthetic
gccaagcatttaggtgacactatagcaacctgcaaatcttcaggagtttcagagctatgctggaaacagc

SEQ ID NO: 67711 - DNA, 70 bp, Artificial Sequence
  Synthetic
gccaagcatttaggtgacactatagccactctgcacggcggctgagtttcagagctatgctggaaacagc

SEQ ID NO: 67712 - DNA, 70 bp, Artificial Sequence
  Synthetic
gccaagcatttaggtgacactatagtcagccactatattcagttggtttcagagctatgctggaaacagc

SEQ ID NO: 67713 - DNA, 70 bp, Artificial Sequence
  Synthetic
gccaagcatttaggtgacactatagagcaggccctgcagctctgagtttcagagctatgctggaaacagc

SEQ ID NO: 67714 - DNA, 70 bp, Artificial Sequence
  Synthetic
gccaagcatttaggtgacactatagtttatgcacagcatccacaagtttcagagctatgctggaaacagc

SEQ ID NO: 67715 - DNA, 70 bp, Artificial Sequence
  Synthetic
gccaagcatttaggtgacactatagaagcttttctgcatttccacgtttcagagctatgctggaaacagc

SEQ ID NO: 67716 - DNA, 70 bp, Artificial Sequence
  Synthetic
gccaagcatttaggtgacactatagggctgactcagcagcagccagtttcagagctatgctggaaacagc

SEQ ID NO: 67717 - DNA, 70 bp, Artificial Sequence
  Synthetic
gccaagcatttaggtgacactataggcctctggtgctcacttcaagtttcagagctatgctggaaacagc

SEQ ID NO: 67718 - DNA, 70 bp, Artificial Sequence
  Synthetic
gccaagcatttaggtgacactatagctctttggtttaagccacttgtttcagagctatgctggaaacagc

SEQ ID NO: 67719 - DNA, 70 bp, Artificial Sequence
  Synthetic
gccaagcatttaggtgacactatagtattatctggtctgtgatccgtttcagagctatgctggaaacagc

SEQ ID NO: 67720 - DNA, 70 bp, Artificial Sequence
  Synthetic
gccaagcatttaggtgacactataggggggtctttatttgagtttgtttcagagctatgctggaaacagc

SEQ ID NO: 67721 - DNA, 70 bp, Artificial Sequence
  Synthetic
gccaagcatttaggtgacactataggttgcggcaccacggattaggtttcagagctatgctggaaacagc

SEQ ID NO: 67722 - DNA, 70 bp, Artificial Sequence
  Synthetic
gccaagcatttaggtgacactataggtggtggcgggcgtcactgcgtttcagagctatgctggaaacagc

SEQ ID NO: 67723 - DNA, 70 bp, Artificial Sequence
  Synthetic
gccaagcatttaggtgacactatagtgcaatcatgacctagaatagtttcagagctatgctggaaacagc

SEQ ID NO: 67724 - DNA, 70 bp, Artificial Sequence
  Synthetic
gccaagcatttaggtgacactatagcccttttggacttcagaagagtttcagagctatgctggaaacagc

SEQ ID NO: 67725 - DNA, 70 bp, Artificial Sequence
  Synthetic
gccaagcatttaggtgacactatagcggagctcactgtttcctaagtttcagagctatgctggaaacagc

SEQ ID NO: 67726 - DNA, 70 bp, Artificial Sequence
  Synthetic
gccaagcatttaggtgacactatagggagcgcccgccggccctgggtttcagagctatgctggaaacagc

SEQ ID NO: 67727 - DNA, 70 bp, Artificial Sequence
  Synthetic
gccaagcatttaggtgacactatagccagtcaatacagacttcacgtttcagagctatgctggaaacagc

SEQ ID NO: 67728 - DNA, 70 bp, Artificial Sequence
  Synthetic
gccaagcatttaggtgacactatagtctgggtttccatcctttacgtttcagagctatgctggaaacagc

SEQ ID NO: 67729 - DNA, 70 bp, Artificial Sequence
  Synthetic
gccaagcatttaggtgacactataggcttggggacacctttctgtgtttcagagctatgctggaaacagc

SEQ ID NO: 67730 - DNA, 70 bp, Artificial Sequence
  Synthetic
gccaagcatttaggtgacactatagagctgtgaaagcaacataaagtttcagagctatgctggaaacagc

SEQ ID NO: 67731 - DNA, 70 bp, Artificial Sequence
  Synthetic
gccaagcatttaggtgacactatagatatgatctagatccttgccgtttcagagctatgctggaaacagc

SEQ ID NO: 67732 - DNA, 70 bp, Artificial Sequence
  Synthetic
gccaagcatttaggtgacactatagagcaagtaaggagtagaagtgtttcagagctatgctggaaacagc

SEQ ID NO: 67733 - DNA, 70 bp, Artificial Sequence
  Synthetic
gccaagcatttaggtgacactataggcgcacacagggtttacagcgtttcagagctatgctggaaacagc

SEQ ID NO: 67734 - DNA, 70 bp, Artificial Sequence
  Synthetic
gccaagcatttaggtgacactatagcccacccagctctgagttcagtttcagagctatgctggaaacagc

SEQ ID NO: 67735 - DNA, 70 bp, Artificial Sequence
  Synthetic
gccaagcatttaggtgacactatagtatcagtctcgggactgagagtttcagagctatgctggaaacagc

SEQ ID NO: 67736 - DNA, 70 bp, Artificial Sequence
  Synthetic
gccaagcatttaggtgacactatagaggtttagcttggtatcctggtttcagagctatgctggaaacagc

SEQ ID NO: 67737 - DNA, 70 bp, Artificial Sequence
  Synthetic
gccaagcatttaggtgacactataggcctcgcagagttgaaataagtttcagagctatgctggaaacagc

SEQ ID NO: 67738 - DNA, 70 bp, Artificial Sequence
  Synthetic
gccaagcatttaggtgacactatagactttctaatgggatgccaggtttcagagctatgctggaaacagc

SEQ ID NO: 67739 - DNA, 70 bp, Artificial Sequence
  Synthetic
gccaagcatttaggtgacactatagcactagcaactctgctctaggtttcagagctatgctggaaacagc

SEQ ID NO: 67740 - DNA, 70 bp, Artificial Sequence
  Synthetic
gccaagcatttaggtgacactataggataactctggacttctcaagtttcagagctatgctggaaacagc

SEQ ID NO: 67741 - DNA, 70 bp, Artificial Sequence
  Synthetic
gccaagcatttaggtgacactatagtcaagagccaatagcacgaagtttcagagctatgctggaaacagc

SEQ ID NO: 67742 - DNA, 70 bp, Artificial Sequence
  Synthetic
gccaagcatttaggtgacactatagaaatggaatcaaaagggcaggtttcagagctatgctggaaacagc

SEQ ID NO: 67743 - DNA, 70 bp, Artificial Sequence
  Synthetic
gccaagcatttaggtgacactatagggaggaccaggagagccaaagtttcagagctatgctggaaacagc

SEQ ID NO: 67744 - DNA, 70 bp, Artificial Sequence
  Synthetic
gccaagcatttaggtgacactatagttcgacgaccccgacacatcgtttcagagctatgctggaaacagc

SEQ ID NO: 67745 - DNA, 70 bp, Artificial Sequence
  Synthetic
gccaagcatttaggtgacactatagaggaaagcaccttagaccgcgtttcagagctatgctggaaacagc

SEQ ID NO: 67746 - DNA, 70 bp, Artificial Sequence
  Synthetic
gccaagcatttaggtgacactatagttgtgtgccagtggtctcaggtttcagagctatgctggaaacagc

SEQ ID NO: 67747 - DNA, 70 bp, Artificial Sequence
  Synthetic
gccaagcatttaggtgacactataggacagaagtgatgctagcgggtttcagagctatgctggaaacagc

SEQ ID NO: 67748 - DNA, 70 bp, Artificial Sequence
  Synthetic
gccaagcatttaggtgacactatagggcagagaaccaagagccctgtttcagagctatgctggaaacagc

SEQ ID NO: 67749 - DNA, 70 bp, Artificial Sequence
  Synthetic
gccaagcatttaggtgacactatagggaggaccaggagatccaaagtttcagagctatgctggaaacagc

SEQ ID NO: 67750 - DNA, 70 bp, Artificial Sequence
  Synthetic
gccaagcatttaggtgacactatagaccgacaggcgagcaacgcagtttcagagctatgctggaaacagc

SEQ ID NO: 67751 - DNA, 70 bp, Artificial Sequence
  Synthetic
gccaagcatttaggtgacactataggctgtgtttgttattcccttgtttcagagctatgctggaaacagc

SEQ ID NO: 67752 - DNA, 70 bp, Artificial Sequence
  Synthetic
gccaagcatttaggtgacactatagacatgaagatggagtgctaagtttcagagctatgctggaaacagc

SEQ ID NO: 67753 - DNA, 70 bp, Artificial Sequence
  Synthetic
gccaagcatttaggtgacactatagcatggaggaggtggattagcgtttcagagctatgctggaaacagc

SEQ ID NO: 67754 - DNA, 70 bp, Artificial Sequence
  Synthetic
gccaagcatttaggtgacactatagctctggtatcccagagtcgcgtttcagagctatgctggaaacagc

SEQ ID NO: 67755 - DNA, 70 bp, Artificial Sequence
  Synthetic
gccaagcatttaggtgacactataggtggctcctggcgctacattgtttcagagctatgctggaaacagc

SEQ ID NO: 67756 - DNA, 70 bp, Artificial Sequence
  Synthetic
gccaagcatttaggtgacactataggactagcccagcagatcacagtttcagagctatgctggaaacagc

SEQ ID NO: 67757 - DNA, 70 bp, Artificial Sequence
  Synthetic
gccaagcatttaggtgacactatagccagagcttagaggtgtcacgtttcagagctatgctggaaacagc

SEQ ID NO: 67758 - DNA, 70 bp, Artificial Sequence
  Synthetic
gccaagcatttaggtgacactataggataaggctactcgtattccgtttcagagctatgctggaaacagc

SEQ ID NO: 67759 - DNA, 70 bp, Artificial Sequence
  Synthetic
gccaagcatttaggtgacactatagttgatgatgttgatccctaggtttcagagctatgctggaaacagc

SEQ ID NO: 67760 - DNA, 70 bp, Artificial Sequence
  Synthetic
gccaagcatttaggtgacactataggcagtttatcttccatcagcgtttcagagctatgctggaaacagc

SEQ ID NO: 67761 - DNA, 70 bp, Artificial Sequence
  Synthetic
gccaagcatttaggtgacactatagggtagaggagacccttcagagtttcagagctatgctggaaacagc

SEQ ID NO: 67762 - DNA, 70 bp, Artificial Sequence
  Synthetic
gccaagcatttaggtgacactatagggtctgtgtgtcacttcagtgtttcagagctatgctggaaacagc

SEQ ID NO: 67763 - DNA, 70 bp, Artificial Sequence
  Synthetic
gccaagcatttaggtgacactatagattttcattctacctgacgagtttcagagctatgctggaaacagc

SEQ ID NO: 67764 - DNA, 70 bp, Artificial Sequence
  Synthetic
gccaagcatttaggtgacactataggctgtcatggagtcaattcagtttcagagctatgctggaaacagc

SEQ ID NO: 67765 - DNA, 70 bp, Artificial Sequence
  Synthetic
gccaagcatttaggtgacactataggccgagtgagtctgtcaagcgtttcagagctatgctggaaacagc

SEQ ID NO: 67766 - DNA, 70 bp, Artificial Sequence
  Synthetic
gccaagcatttaggtgacactatagacaccaggccaaagctggatgtttcagagctatgctggaaacagc

SEQ ID NO: 67767 - DNA, 70 bp, Artificial Sequence
  Synthetic
gccaagcatttaggtgacactatagattcttcagacttgcactccgtttcagagctatgctggaaacagc

SEQ ID NO: 67768 - DNA, 70 bp, Artificial Sequence
  Synthetic
gccaagcatttaggtgacactatagtgattgcagaaatatcactggtttcagagctatgctggaaacagc

SEQ ID NO: 67769 - DNA, 70 bp, Artificial Sequence
  Synthetic
gccaagcatttaggtgacactatagtcatacttgccaaattgagggtttcagagctatgctggaaacagc

SEQ ID NO: 67770 - DNA, 70 bp, Artificial Sequence
  Synthetic
gccaagcatttaggtgacactatagtcttctgcttgaagtatatcgtttcagagctatgctggaaacagc

SEQ ID NO: 67771 - DNA, 70 bp, Artificial Sequence
  Synthetic
gccaagcatttaggtgacactatagcctaatgtcaagaagcagctgtttcagagctatgctggaaacagc

SEQ ID NO: 67772 - DNA, 70 bp, Artificial Sequence
  Synthetic
gccaagcatttaggtgacactatagcacattagaagaccagtctggtttcagagctatgctggaaacagc

SEQ ID NO: 67773 - DNA, 70 bp, Artificial Sequence
  Synthetic
gccaagcatttaggtgacactatagttccacaggggcacagtcaggtttcagagctatgctggaaacagc

SEQ ID NO: 67774 - DNA, 70 bp, Artificial Sequence
  Synthetic
gccaagcatttaggtgacactatagagtggggaagactacccgtcgtttcagagctatgctggaaacagc

SEQ ID NO: 67775 - DNA, 70 bp, Artificial Sequence
  Synthetic
gccaagcatttaggtgacactatagacctctacagaaagaacttagtttcagagctatgctggaaacagc

SEQ ID NO: 67776 - DNA, 70 bp, Artificial Sequence
  Synthetic
gccaagcatttaggtgacactatagggaggaggatttaatacagtgtttcagagctatgctggaaacagc

SEQ ID NO: 67777 - DNA, 70 bp, Artificial Sequence
  Synthetic
gccaagcatttaggtgacactatagccaaccagcagggggcttgagtttcagagctatgctggaaacagc

SEQ ID NO: 67778 - DNA, 70 bp, Artificial Sequence
  Synthetic
gccaagcatttaggtgacactatagggggaaggatgtcagtcaccgtttcagagctatgctggaaacagc

SEQ ID NO: 67779 - DNA, 70 bp, Artificial Sequence
  Synthetic
gccaagcatttaggtgacactatagtcccgagtggctgggatgacgtttcagagctatgctggaaacagc

SEQ ID NO: 67780 - DNA, 70 bp, Artificial Sequence
  Synthetic
gccaagcatttaggtgacactatagatcgtggagtcagcattagtgtttcagagctatgctggaaacagc

SEQ ID NO: 67781 - DNA, 70 bp, Artificial Sequence
  Synthetic
gccaagcatttaggtgacactataggttatctgaagctccccacggtttcagagctatgctggaaacagc

SEQ ID NO: 67782 - DNA, 70 bp, Artificial Sequence
  Synthetic
gccaagcatttaggtgacactatagcgtctctttgagtatggccagtttcagagctatgctggaaacagc

SEQ ID NO: 67783 - DNA, 70 bp, Artificial Sequence
  Synthetic
gccaagcatttaggtgacactatagtaccggagtccagcttttgagtttcagagctatgctggaaacagc

SEQ ID NO: 67784 - DNA, 70 bp, Artificial Sequence
  Synthetic
gccaagcatttaggtgacactatagcattgtctttggatcagctagtttcagagctatgctggaaacagc

SEQ ID NO: 67785 - DNA, 70 bp, Artificial Sequence
  Synthetic
gccaagcatttaggtgacactatagattctgctctgctacttgtagtttcagagctatgctggaaacagc

SEQ ID NO: 67786 - DNA, 70 bp, Artificial Sequence
  Synthetic
gccaagcatttaggtgacactataggaatgcttcttggcagctctgtttcagagctatgctggaaacagc

SEQ ID NO: 67787 - DNA, 70 bp, Artificial Sequence
  Synthetic
gccaagcatttaggtgacactataggcactaagtgctcttgattcgtttcagagctatgctggaaacagc

SEQ ID NO: 67788 - DNA, 70 bp, Artificial Sequence
  Synthetic
gccaagcatttaggtgacactatagtaatcagctttgtcagaagtgtttcagagctatgctggaaacagc

SEQ ID NO: 67789 - DNA, 70 bp, Artificial Sequence
  Synthetic
gccaagcatttaggtgacactatagtactgatgctctatgactacgtttcagagctatgctggaaacagc

SEQ ID NO: 67790 - DNA, 70 bp, Artificial Sequence
  Synthetic
gccaagcatttaggtgacactatagttgtgaaaagtcacggcttcgtttcagagctatgctggaaacagc

SEQ ID NO: 67791 - DNA, 70 bp, Artificial Sequence
  Synthetic
gccaagcatttaggtgacactatagtttagtgctttctctttacggtttcagagctatgctggaaacagc

SEQ ID NO: 67792 - DNA, 70 bp, Artificial Sequence
  Synthetic
gccaagcatttaggtgacactatagatgccagaagaagggtttaagtttcagagctatgctggaaacagc

SEQ ID NO: 67793 - DNA, 70 bp, Artificial Sequence
  Synthetic
gccaagcatttaggtgacactatagcaaaggttacctgctggagcgtttcagagctatgctggaaacagc

SEQ ID NO: 67794 - DNA, 70 bp, Artificial Sequence
  Synthetic
gccaagcatttaggtgacactatagccacagacattttcctgaatgtttcagagctatgctggaaacagc

SEQ ID NO: 67795 - DNA, 70 bp, Artificial Sequence
  Synthetic
gccaagcatttaggtgacactatagggggtgggggacacggaaaggtttcagagctatgctggaaacagc

SEQ ID NO: 67796 - DNA, 70 bp, Artificial Sequence
  Synthetic
gccaagcatttaggtgacactataggggtgaggcaggctcttagcgtttcagagctatgctggaaacagc

SEQ ID NO: 67797 - DNA, 70 bp, Artificial Sequence
  Synthetic
gccaagcatttaggtgacactatagtatcaaagctatatcaggccgtttcagagctatgctggaaacagc

SEQ ID NO: 67798 - DNA, 70 bp, Artificial Sequence
  Synthetic
gccaagcatttaggtgacactatagaggacttactctacagtgaagtttcagagctatgctggaaacagc

SEQ ID NO: 67799 - DNA, 70 bp, Artificial Sequence
  Synthetic
gccaagcatttaggtgacactatagctctcttttccagagagcaggtttcagagctatgctggaaacagc

SEQ ID NO: 67800 - DNA, 70 bp, Artificial Sequence
  Synthetic
gccaagcatttaggtgacactatagaccctctgctggaagaacaggtttcagagctatgctggaaacagc

SEQ ID NO: 67801 - DNA, 70 bp, Artificial Sequence
  Synthetic
gccaagcatttaggtgacactatagtgcagcacagtcaatggtaagtttcagagctatgctggaaacagc

SEQ ID NO: 67802 - DNA, 70 bp, Artificial Sequence
  Synthetic
gccaagcatttaggtgacactataggatggcagacacaagcagtagtttcagagctatgctggaaacagc

SEQ ID NO: 67803 - DNA, 70 bp, Artificial Sequence
  Synthetic
gccaagcatttaggtgacactatagctcacagcaacactgactctgtttcagagctatgctggaaacagc

SEQ ID NO: 67804 - DNA, 70 bp, Artificial Sequence
  Synthetic
gccaagcatttaggtgacactatagaccagcttggaaatcagttagtttcagagctatgctggaaacagc

SEQ ID NO: 67805 - DNA, 70 bp, Artificial Sequence
  Synthetic
gccaagcatttaggtgacactatagataacctatgtctccttatggtttcagagctatgctggaaacagc

SEQ ID NO: 67806 - DNA, 70 bp, Artificial Sequence
  Synthetic
gccaagcatttaggtgacactatagatgtgcatttcattgatcctgtttcagagctatgctggaaacagc

SEQ ID NO: 67807 - DNA, 70 bp, Artificial Sequence
  Synthetic
gccaagcatttaggtgacactatagagtatcctcacctcagatgagtttcagagctatgctggaaacagc

SEQ ID NO: 67808 - DNA, 70 bp, Artificial Sequence
  Synthetic
gccaagcatttaggtgacactatagtgctaaagcatttaatgctggtttcagagctatgctggaaacagc

SEQ ID NO: 67809 - DNA, 70 bp, Artificial Sequence
  Synthetic
gccaagcatttaggtgacactatagacaggatgatgaaaagtggcgtttcagagctatgctggaaacagc

SEQ ID NO: 67810 - DNA, 70 bp, Artificial Sequence
  Synthetic
gccaagcatttaggtgacactatagtggccgcagccgggactcacgtttcagagctatgctggaaacagc

SEQ ID NO: 67811 - DNA, 70 bp, Artificial Sequence
  Synthetic
gccaagcatttaggtgacactatagagtgaaggtgaagaaagaaagtttcagagctatgctggaaacagc

SEQ ID NO: 67812 - DNA, 70 bp, Artificial Sequence
  Synthetic
gccaagcatttaggtgacactatagcagctgttttttgtgacgtggtttcagagctatgctggaaacagc

SEQ ID NO: 67813 - DNA, 70 bp, Artificial Sequence
  Synthetic
gccaagcatttaggtgacactatagttcttctttattgtgacgtggtttcagagctatgctggaaacagc

SEQ ID NO: 67814 - DNA, 70 bp, Artificial Sequence
  Synthetic
gccaagcatttaggtgacactataggtgttggaacacacatctgagtttcagagctatgctggaaacagc

SEQ ID NO: 67815 - DNA, 70 bp, Artificial Sequence
  Synthetic
gccaagcatttaggtgacactatagagggcaaggccctgatgtatgtttcagagctatgctggaaacagc

SEQ ID NO: 67816 - DNA, 70 bp, Artificial Sequence
  Synthetic
gccaagcatttaggtgacactatagcctgaaagatttagcaatgggtttcagagctatgctggaaacagc

SEQ ID NO: 67817 - DNA, 70 bp, Artificial Sequence
  Synthetic
gccaagcatttaggtgacactatagtctgagaagcagaatgcagagtttcagagctatgctggaaacagc

SEQ ID NO: 67818 - DNA, 70 bp, Artificial Sequence
  Synthetic
gccaagcatttaggtgacactataggaattatctggcattcgtgcgtttcagagctatgctggaaacagc

SEQ ID NO: 67819 - DNA, 70 bp, Artificial Sequence
  Synthetic
gccaagcatttaggtgacactatagttcttctttttaatgggtgggtttcagagctatgctggaaacagc

SEQ ID NO: 67820 - DNA, 70 bp, Artificial Sequence
  Synthetic
gccaagcatttaggtgacactatagaaacatgctatgcatcagacgtttcagagctatgctggaaacagc

SEQ ID NO: 67821 - DNA, 70 bp, Artificial Sequence
  Synthetic
gccaagcatttaggtgacactatagaaatgttcccagcaggccacgtttcagagctatgctggaaacagc

SEQ ID NO: 67822 - DNA, 70 bp, Artificial Sequence
  Synthetic
gccaagcatttaggtgacactataggtgagactcctgattgcttcgtttcagagctatgctggaaacagc

SEQ ID NO: 67823 - DNA, 70 bp, Artificial Sequence
  Synthetic
gccaagcatttaggtgacactataggagacgtcctatgctgtagagtttcagagctatgctggaaacagc

SEQ ID NO: 67824 - DNA, 70 bp, Artificial Sequence
  Synthetic
gccaagcatttaggtgacactataggcccctccgcgtgctcacgcgtttcagagctatgctggaaacagc

SEQ ID NO: 67825 - DNA, 70 bp, Artificial Sequence
  Synthetic
gccaagcatttaggtgacactatagttttaaaagtttaccgggcagtttcagagctatgctggaaacagc

SEQ ID NO: 67826 - DNA, 70 bp, Artificial Sequence
  Synthetic
gccaagcatttaggtgacactataggctcgaacagtacaaaatgggtttcagagctatgctggaaacagc

SEQ ID NO: 67827 - DNA, 70 bp, Artificial Sequence
  Synthetic
gccaagcatttaggtgacactatagggtgcatctttcctggaatagtttcagagctatgctggaaacagc

SEQ ID NO: 67828 - DNA, 70 bp, Artificial Sequence
  Synthetic
gccaagcatttaggtgacactatagtcattactgtagcatttgtggtttcagagctatgctggaaacagc

SEQ ID NO: 67829 - DNA, 70 bp, Artificial Sequence
  Synthetic
gccaagcatttaggtgacactataggacctgctcacttcacttatgtttcagagctatgctggaaacagc

SEQ ID NO: 67830 - DNA, 70 bp, Artificial Sequence
  Synthetic
gccaagcatttaggtgacactatagagttcagtgcgtagttaaacgtttcagagctatgctggaaacagc

SEQ ID NO: 67831 - DNA, 70 bp, Artificial Sequence
  Synthetic
gccaagcatttaggtgacactatagaaaagtgaggagttcagctggtttcagagctatgctggaaacagc

SEQ ID NO: 67832 - DNA, 70 bp, Artificial Sequence
  Synthetic
gccaagcatttaggtgacactatagggatggggggaagaagtcaagtttcagagctatgctggaaacagc

SEQ ID NO: 67833 - DNA, 70 bp, Artificial Sequence
  Synthetic
gccaagcatttaggtgacactatagctccgtgccaggcctgtcaggtttcagagctatgctggaaacagc

SEQ ID NO: 67834 - DNA, 70 bp, Artificial Sequence
  Synthetic
gccaagcatttaggtgacactatagagccatctgtgccatcatcggtttcagagctatgctggaaacagc

SEQ ID NO: 67835 - DNA, 70 bp, Artificial Sequence
  Synthetic
gccaagcatttaggtgacactatagaggttttctagaagtcaccagtttcagagctatgctggaaacagc

SEQ ID NO: 67836 - DNA, 70 bp, Artificial Sequence
  Synthetic
gccaagcatttaggtgacactatagtatgatgatgatgaggatgagtttcagagctatgctggaaacagc

SEQ ID NO: 67837 - DNA, 70 bp, Artificial Sequence
  Synthetic
gccaagcatttaggtgacactatagcatcatcatcatcatcgtgtgtttcagagctatgctggaaacagc

SEQ ID NO: 67838 - DNA, 70 bp, Artificial Sequence
  Synthetic
gccaagcatttaggtgacactatagagcagcaaccaaagccatgagtttcagagctatgctggaaacagc

SEQ ID NO: 67839 - DNA, 70 bp, Artificial Sequence
  Synthetic
gccaagcatttaggtgacactataggaccagctgggtcagttcccgtttcagagctatgctggaaacagc

SEQ ID NO: 67840 - DNA, 70 bp, Artificial Sequence
  Synthetic
gccaagcatttaggtgacactataggccaagctgtgtgaagaaatgtttcagagctatgctggaaacagc

SEQ ID NO: 67841 - DNA, 70 bp, Artificial Sequence
  Synthetic
gccaagcatttaggtgacactatagtggttcaatctgaagttcacgtttcagagctatgctggaaacagc

SEQ ID NO: 67842 - DNA, 70 bp, Artificial Sequence
  Synthetic
gccaagcatttaggtgacactataggttccctgttacttaagagagtttcagagctatgctggaaacagc

SEQ ID NO: 67843 - DNA, 70 bp, Artificial Sequence
  Synthetic
gccaagcatttaggtgacactatagatgtctcagactgtaagcgagtttcagagctatgctggaaacagc

SEQ ID NO: 67844 - DNA, 70 bp, Artificial Sequence
  Synthetic
gccaagcatttaggtgacactataggctgttgcacagtcacactggtttcagagctatgctggaaacagc

SEQ ID NO: 67845 - DNA, 70 bp, Artificial Sequence
  Synthetic
gccaagcatttaggtgacactatagacaacaagaagtgaaggaaggtttcagagctatgctggaaacagc

SEQ ID NO: 67846 - DNA, 70 bp, Artificial Sequence
  Synthetic
gccaagcatttaggtgacactatagagccaggcttaggagcaacggtttcagagctatgctggaaacagc

SEQ ID NO: 67847 - DNA, 70 bp, Artificial Sequence
  Synthetic
gccaagcatttaggtgacactatagctgtgcatgctacctctacagtttcagagctatgctggaaacagc

SEQ ID NO: 67848 - DNA, 70 bp, Artificial Sequence
  Synthetic
gccaagcatttaggtgacactatagtggtggatcacagcatcttcgtttcagagctatgctggaaacagc

SEQ ID NO: 67849 - DNA, 70 bp, Artificial Sequence
  Synthetic
gccaagcatttaggtgacactataggggatgatgagttagagctcgtttcagagctatgctggaaacagc

SEQ ID NO: 67850 - DNA, 70 bp, Artificial Sequence
  Synthetic
gccaagcatttaggtgacactatagtaccagatccgggtctgagggtttcagagctatgctggaaacagc

SEQ ID NO: 67851 - DNA, 70 bp, Artificial Sequence
  Synthetic
gccaagcatttaggtgacactatagcggtatggcttggctaaattgtttcagagctatgctggaaacagc

SEQ ID NO: 67852 - DNA, 70 bp, Artificial Sequence
  Synthetic
gccaagcatttaggtgacactatagtctctctctggcttagatgtgtttcagagctatgctggaaacagc

SEQ ID NO: 67853 - DNA, 70 bp, Artificial Sequence
  Synthetic
gccaagcatttaggtgacactataggtccaggagctgaggaagcggtttcagagctatgctggaaacagc

SEQ ID NO: 67854 - DNA, 70 bp, Artificial Sequence
  Synthetic
gccaagcatttaggtgacactataggggccagagaaggagaactagtttcagagctatgctggaaacagc

SEQ ID NO: 67855 - DNA, 70 bp, Artificial Sequence
  Synthetic
gccaagcatttaggtgacactatagccacctgggtcctcagttacgtttcagagctatgctggaaacagc

SEQ ID NO: 67856 - DNA, 70 bp, Artificial Sequence
  Synthetic
gccaagcatttaggtgacactataggttccctgccaactacgtgggtttcagagctatgctggaaacagc

SEQ ID NO: 67857 - DNA, 70 bp, Artificial Sequence
  Synthetic
gccaagcatttaggtgacactataggtccacgttcctgccgtcacgtttcagagctatgctggaaacagc

SEQ ID NO: 67858 - DNA, 70 bp, Artificial Sequence
  Synthetic
gccaagcatttaggtgacactatagtccatccacatatgtggaaggtttcagagctatgctggaaacagc

SEQ ID NO: 67859 - DNA, 70 bp, Artificial Sequence
  Synthetic
gccaagcatttaggtgacactatagaggggccgagaaaaaagcgcgtttcagagctatgctggaaacagc

SEQ ID NO: 67860 - DNA, 70 bp, Artificial Sequence
  Synthetic
gccaagcatttaggtgacactataggggtggcagcccctatagtggtttcagagctatgctggaaacagc

SEQ ID NO: 67861 - DNA, 70 bp, Artificial Sequence
  Synthetic
gccaagcatttaggtgacactataggttagctttcttgcagctgcgtttcagagctatgctggaaacagc

SEQ ID NO: 67862 - DNA, 70 bp, Artificial Sequence
  Synthetic
gccaagcatttaggtgacactatagccagcattatgctttgttctgtttcagagctatgctggaaacagc

SEQ ID NO: 67863 - DNA, 70 bp, Artificial Sequence
  Synthetic
gccaagcatttaggtgacactatagcaagaaaagccaacatgaaggtttcagagctatgctggaaacagc

SEQ ID NO: 67864 - DNA, 70 bp, Artificial Sequence
  Synthetic
gccaagcatttaggtgacactataggccggaggtggcaggagtcggtttcagagctatgctggaaacagc

SEQ ID NO: 67865 - DNA, 70 bp, Artificial Sequence
  Synthetic
gccaagcatttaggtgacactatagaggctcagccaggtgcctacgtttcagagctatgctggaaacagc

SEQ ID NO: 67866 - DNA, 70 bp, Artificial Sequence
  Synthetic
gccaagcatttaggtgacactatagtgatgacctgtatggctaaggtttcagagctatgctggaaacagc

SEQ ID NO: 67867 - DNA, 70 bp, Artificial Sequence
  Synthetic
gccaagcatttaggtgacactataggactaacacaactgagccaagtttcagagctatgctggaaacagc

SEQ ID NO: 67868 - DNA, 70 bp, Artificial Sequence
  Synthetic
gccaagcatttaggtgacactataggatgattaaaggcttcacgagtttcagagctatgctggaaacagc

SEQ ID NO: 67869 - DNA, 70 bp, Artificial Sequence
  Synthetic
gccaagcatttaggtgacactatagcggctgggcctgaacttagtgtttcagagctatgctggaaacagc

SEQ ID NO: 67870 - DNA, 70 bp, Artificial Sequence
  Synthetic
gccaagcatttaggtgacactatagagaactaccgagtgtgtagagtttcagagctatgctggaaacagc

SEQ ID NO: 67871 - DNA, 70 bp, Artificial Sequence
  Synthetic
gccaagcatttaggtgacactatagtagttgctgctcagggagatgtttcagagctatgctggaaacagc

SEQ ID NO: 67872 - DNA, 70 bp, Artificial Sequence
  Synthetic
gccaagcatttaggtgacactatagccacaagcttggtctaggacgtttcagagctatgctggaaacagc

SEQ ID NO: 67873 - DNA, 70 bp, Artificial Sequence
  Synthetic
gccaagcatttaggtgacactatagtgggctcgccctggagttgggtttcagagctatgctggaaacagc

SEQ ID NO: 67874 - DNA, 70 bp, Artificial Sequence
  Synthetic
gccaagcatttaggtgacactatagtttgaactggaagcttaatggtttcagagctatgctggaaacagc

SEQ ID NO: 67875 - DNA, 70 bp, Artificial Sequence
  Synthetic
gccaagcatttaggtgacactatagggcaatgagatctcctgactgtttcagagctatgctggaaacagc

SEQ ID NO: 67876 - DNA, 70 bp, Artificial Sequence
  Synthetic
gccaagcatttaggtgacactatagacgcgagtctgtgtttttgcgtttcagagctatgctggaaacagc

SEQ ID NO: 67877 - DNA, 70 bp, Artificial Sequence
  Synthetic
gccaagcatttaggtgacactatagcgttctgtatcagtctttccgtttcagagctatgctggaaacagc

SEQ ID NO: 67878 - DNA, 70 bp, Artificial Sequence
  Synthetic
gccaagcatttaggtgacactataggacaagccgaggcggtgagcgtttcagagctatgctggaaacagc

SEQ ID NO: 67879 - DNA, 70 bp, Artificial Sequence
  Synthetic
gccaagcatttaggtgacactatagtgtgtcaccttcgcagcttcgtttcagagctatgctggaaacagc

SEQ ID NO: 67880 - DNA, 70 bp, Artificial Sequence
  Synthetic
gccaagcatttaggtgacactatagttcctccgttgccaagggcggtttcagagctatgctggaaacagc

SEQ ID NO: 67881 - DNA, 70 bp, Artificial Sequence
  Synthetic
gccaagcatttaggtgacactataggtcgttgtgtcccttcatatgtttcagagctatgctggaaacagc

SEQ ID NO: 67882 - DNA, 70 bp, Artificial Sequence
  Synthetic
gccaagcatttaggtgacactatagcgctgaatcaaggattctttgtttcagagctatgctggaaacagc

SEQ ID NO: 67883 - DNA, 70 bp, Artificial Sequence
  Synthetic
gccaagcatttaggtgacactatagacgggggatgcattttgagggtttcagagctatgctggaaacagc

SEQ ID NO: 67884 - DNA, 70 bp, Artificial Sequence
  Synthetic
gccaagcatttaggtgacactatagagatctcctggctgatcacagtttcagagctatgctggaaacagc

SEQ ID NO: 67885 - DNA, 70 bp, Artificial Sequence
  Synthetic
gccaagcatttaggtgacactatagagaagtaaccacatatctgtgtttcagagctatgctggaaacagc

SEQ ID NO: 67886 - DNA, 70 bp, Artificial Sequence
  Synthetic
gccaagcatttaggtgacactatagtgagcttggggacatgttttgtttcagagctatgctggaaacagc

SEQ ID NO: 67887 - DNA, 70 bp, Artificial Sequence
  Synthetic
gccaagcatttaggtgacactatagctttgcctacatcaccgcctgtttcagagctatgctggaaacagc

SEQ ID NO: 67888 - DNA, 70 bp, Artificial Sequence
  Synthetic
gccaagcatttaggtgacactatagaagtccgcatggaattagaggtttcagagctatgctggaaacagc

SEQ ID NO: 67889 - DNA, 70 bp, Artificial Sequence
  Synthetic
gccaagcatttaggtgacactatagacagacttttggtggtgagggtttcagagctatgctggaaacagc

SEQ ID NO: 67890 - DNA, 70 bp, Artificial Sequence
  Synthetic
gccaagcatttaggtgacactatagcagaggcagaaaggcagaaggtttcagagctatgctggaaacagc

SEQ ID NO: 67891 - DNA, 70 bp, Artificial Sequence
  Synthetic
gccaagcatttaggtgacactatagggaccgggaagggcagtcacgtttcagagctatgctggaaacagc

SEQ ID NO: 67892 - DNA, 70 bp, Artificial Sequence
  Synthetic
gccaagcatttaggtgacactatagaacttgactaaagatgctgcgtttcagagctatgctggaaacagc

SEQ ID NO: 67893 - DNA, 70 bp, Artificial Sequence
  Synthetic
gccaagcatttaggtgacactatagctgggtcagcagatcagctcgtttcagagctatgctggaaacagc

SEQ ID NO: 67894 - DNA, 70 bp, Artificial Sequence
  Synthetic
gccaagcatttaggtgacactatagcccagcgtgggattcgatacgtttcagagctatgctggaaacagc

SEQ ID NO: 67895 - DNA, 70 bp, Artificial Sequence
  Synthetic
gccaagcatttaggtgacactataggattgtgtgtttcagtaccagtttcagagctatgctggaaacagc

SEQ ID NO: 67896 - DNA, 70 bp, Artificial Sequence
  Synthetic
gccaagcatttaggtgacactatagcccctctgtggtctcctgaagtttcagagctatgctggaaacagc

SEQ ID NO: 67897 - DNA, 70 bp, Artificial Sequence
  Synthetic
gccaagcatttaggtgacactatagcgcattgcacatcaacggatgtttcagagctatgctggaaacagc

SEQ ID NO: 67898 - DNA, 70 bp, Artificial Sequence
  Synthetic
gccaagcatttaggtgacactatagtatacactgcagtgtgatgtgtttcagagctatgctggaaacagc

SEQ ID NO: 67899 - DNA, 70 bp, Artificial Sequence
  Synthetic
gccaagcatttaggtgacactatagaggttttgttgcttccatcggtttcagagctatgctggaaacagc

SEQ ID NO: 67900 - DNA, 70 bp, Artificial Sequence
  Synthetic
gccaagcatttaggtgacactatagcggcaggagaaaaagcagctgtttcagagctatgctggaaacagc

SEQ ID NO: 67901 - DNA, 70 bp, Artificial Sequence
  Synthetic
gccaagcatttaggtgacactatagggttgaaactagagatggacgtttcagagctatgctggaaacagc

SEQ ID NO: 67902 - DNA, 70 bp, Artificial Sequence
  Synthetic
gccaagcatttaggtgacactatagttctaactcttctggaaagtgtttcagagctatgctggaaacagc

SEQ ID NO: 67903 - DNA, 70 bp, Artificial Sequence
  Synthetic
gccaagcatttaggtgacactatagagataaaggatcagcagagggtttcagagctatgctggaaacagc

SEQ ID NO: 67904 - DNA, 70 bp, Artificial Sequence
  Synthetic
gccaagcatttaggtgacactataggggatcctggtggtcagaccgtttcagagctatgctggaaacagc

SEQ ID NO: 67905 - DNA, 70 bp, Artificial Sequence
  Synthetic
gccaagcatttaggtgacactatagggggtggggctagatgaccggtttcagagctatgctggaaacagc

SEQ ID NO: 67906 - DNA, 70 bp, Artificial Sequence
  Synthetic
gccaagcatttaggtgacactataggttagtggaggcagtggtaggtttcagagctatgctggaaacagc

SEQ ID NO: 67907 - DNA, 70 bp, Artificial Sequence
  Synthetic
gccaagcatttaggtgacactatagattgcccatgcaaacaactcgtttcagagctatgctggaaacagc

SEQ ID NO: 67908 - DNA, 70 bp, Artificial Sequence
  Synthetic
gccaagcatttaggtgacactatagcggtcaagctccactggctcgtttcagagctatgctggaaacagc

SEQ ID NO: 67909 - DNA, 70 bp, Artificial Sequence
  Synthetic
gccaagcatttaggtgacactatagctgctctgaattcagttccggtttcagagctatgctggaaacagc

SEQ ID NO: 67910 - DNA, 70 bp, Artificial Sequence
  Synthetic
gccaagcatttaggtgacactatagaaccccagggcaaggctaaggtttcagagctatgctggaaacagc

SEQ ID NO: 67911 - DNA, 70 bp, Artificial Sequence
  Synthetic
gccaagcatttaggtgacactatagaatcatagagcacgaagaacgtttcagagctatgctggaaacagc

SEQ ID NO: 67912 - DNA, 70 bp, Artificial Sequence
  Synthetic
gccaagcatttaggtgacactataggaaaggggcttgagactgttgtttcagagctatgctggaaacagc

SEQ ID NO: 67913 - DNA, 70 bp, Artificial Sequence
  Synthetic
gccaagcatttaggtgacactatagtgtcgggcgtcagtcctgctgtttcagagctatgctggaaacagc

SEQ ID NO: 67914 - DNA, 70 bp, Artificial Sequence
  Synthetic
gccaagcatttaggtgacactatagggtagacacagtgcttctgtgtttcagagctatgctggaaacagc

SEQ ID NO: 67915 - DNA, 70 bp, Artificial Sequence
  Synthetic
gccaagcatttaggtgacactatagacagtggcgtgaaggcaaacgtttcagagctatgctggaaacagc

SEQ ID NO: 67916 - DNA, 70 bp, Artificial Sequence
  Synthetic
gccaagcatttaggtgacactatagtgcattccgggctcacactggtttcagagctatgctggaaacagc

SEQ ID NO: 67917 - DNA, 70 bp, Artificial Sequence
  Synthetic
gccaagcatttaggtgacactatagattctgctgccgcagttgaagtttcagagctatgctggaaacagc

SEQ ID NO: 67918 - DNA, 70 bp, Artificial Sequence
  Synthetic
gccaagcatttaggtgacactatagcaggggtcgaggatcccttggtttcagagctatgctggaaacagc

SEQ ID NO: 67919 - DNA, 70 bp, Artificial Sequence
  Synthetic
gccaagcatttaggtgacactatagtgcgcgcgcgggaacgtcctgtttcagagctatgctggaaacagc

SEQ ID NO: 67920 - DNA, 70 bp, Artificial Sequence
  Synthetic
gccaagcatttaggtgacactatagccagcagcggttgaactcaggtttcagagctatgctggaaacagc

SEQ ID NO: 67921 - DNA, 70 bp, Artificial Sequence
  Synthetic
gccaagcatttaggtgacactatagcatggcatgacaaccagattgtttcagagctatgctggaaacagc

SEQ ID NO: 67922 - DNA, 70 bp, Artificial Sequence
  Synthetic
gccaagcatttaggtgacactataggcagcagatactgcagagccgtttcagagctatgctggaaacagc

SEQ ID NO: 67923 - DNA, 70 bp, Artificial Sequence
  Synthetic
gccaagcatttaggtgacactataggagaactatctgaccagcttgtttcagagctatgctggaaacagc

SEQ ID NO: 67924 - DNA, 70 bp, Artificial Sequence
  Synthetic
gccaagcatttaggtgacactatagtatacaggttttgttttgccgtttcagagctatgctggaaacagc

SEQ ID NO: 67925 - DNA, 70 bp, Artificial Sequence
  Synthetic
gccaagcatttaggtgacactatagacttcttagtactgccacatgtttcagagctatgctggaaacagc

SEQ ID NO: 67926 - DNA, 70 bp, Artificial Sequence
  Synthetic
gccaagcatttaggtgacactatagttattcttgcttgtgctgtggtttcagagctatgctggaaacagc

SEQ ID NO: 67927 - DNA, 70 bp, Artificial Sequence
  Synthetic
gccaagcatttaggtgacactatagactcactttacagctcatgtgtttcagagctatgctggaaacagc

SEQ ID NO: 67928 - DNA, 70 bp, Artificial Sequence
  Synthetic
gccaagcatttaggtgacactatagaacaccagcatgcacatgacgtttcagagctatgctggaaacagc

SEQ ID NO: 67929 - DNA, 70 bp, Artificial Sequence
  Synthetic
gccaagcatttaggtgacactataggctctgctaaaggagatcacgtttcagagctatgctggaaacagc

SEQ ID NO: 67930 - DNA, 70 bp, Artificial Sequence
  Synthetic
gccaagcatttaggtgacactataggtagtgaaggccaagtagtggtttcagagctatgctggaaacagc

SEQ ID NO: 67931 - DNA, 70 bp, Artificial Sequence
  Synthetic
gccaagcatttaggtgacactatagacggtctcgtgggctgctaagtttcagagctatgctggaaacagc

SEQ ID NO: 67932 - DNA, 70 bp, Artificial Sequence
  Synthetic
gccaagcatttaggtgacactatagctctgctgtcttcagttcaagtttcagagctatgctggaaacagc

SEQ ID NO: 67933 - DNA, 70 bp, Artificial Sequence
  Synthetic
gccaagcatttaggtgacactataggctacggctttagtccctaggtttcagagctatgctggaaacagc

SEQ ID NO: 67934 - DNA, 70 bp, Artificial Sequence
  Synthetic
gccaagcatttaggtgacactatagggctgcttaagtgcccctccgtttcagagctatgctggaaacagc

SEQ ID NO: 67935 - DNA, 70 bp, Artificial Sequence
  Synthetic
gccaagcatttaggtgacactatagaaattcaattctacagggaggtttcagagctatgctggaaacagc

SEQ ID NO: 67936 - DNA, 70 bp, Artificial Sequence
  Synthetic
gccaagcatttaggtgacactatagcaggcagtgttctctgtcaggtttcagagctatgctggaaacagc

SEQ ID NO: 67937 - DNA, 70 bp, Artificial Sequence
  Synthetic
gccaagcatttaggtgacactatagtacaggttgagggatgggacgtttcagagctatgctggaaacagc

SEQ ID NO: 67938 - DNA, 70 bp, Artificial Sequence
  Synthetic
gccaagcatttaggtgacactatagaaaataaagccctgaggaaagtttcagagctatgctggaaacagc

SEQ ID NO: 67939 - DNA, 70 bp, Artificial Sequence
  Synthetic
gccaagcatttaggtgacactataggcaacggtgactttcaaagtgtttcagagctatgctggaaacagc

SEQ ID NO: 67940 - DNA, 70 bp, Artificial Sequence
  Synthetic
gccaagcatttaggtgacactatagtccaatcccggcacttcagggtttcagagctatgctggaaacagc

SEQ ID NO: 67941 - DNA, 70 bp, Artificial Sequence
  Synthetic
gccaagcatttaggtgacactatagcctgaggtctgtgattaagagtttcagagctatgctggaaacagc

SEQ ID NO: 67942 - DNA, 70 bp, Artificial Sequence
  Synthetic
gccaagcatttaggtgacactatagtatgacagacaggaatctgagtttcagagctatgctggaaacagc

SEQ ID NO: 67943 - DNA, 70 bp, Artificial Sequence
  Synthetic
gccaagcatttaggtgacactatagaaaccgagagcagctggagcgtttcagagctatgctggaaacagc

SEQ ID NO: 67944 - DNA, 70 bp, Artificial Sequence
  Synthetic
gccaagcatttaggtgacactataggcacaagcccagaagaagtggtttcagagctatgctggaaacagc

SEQ ID NO: 67945 - DNA, 70 bp, Artificial Sequence
  Synthetic
gccaagcatttaggtgacactatagcagctcagttggctgtaggagtttcagagctatgctggaaacagc

SEQ ID NO: 67946 - DNA, 70 bp, Artificial Sequence
  Synthetic
gccaagcatttaggtgacactatagggcgtcaagttcttctagcagtttcagagctatgctggaaacagc

SEQ ID NO: 67947 - DNA, 70 bp, Artificial Sequence
  Synthetic
gccaagcatttaggtgacactatagatggatggtgcaccagtaaagtttcagagctatgctggaaacagc

SEQ ID NO: 67948 - DNA, 70 bp, Artificial Sequence
  Synthetic
gccaagcatttaggtgacactatagtcctgttcagttcacatttcgtttcagagctatgctggaaacagc

SEQ ID NO: 67949 - DNA, 70 bp, Artificial Sequence
  Synthetic
gccaagcatttaggtgacactatagtgacaacaactgcaggcagtgtttcagagctatgctggaaacagc

SEQ ID NO: 67950 - DNA, 70 bp, Artificial Sequence
  Synthetic
gccaagcatttaggtgacactatagcatgtcggcgtcagatgagcgtttcagagctatgctggaaacagc

SEQ ID NO: 67951 - DNA, 70 bp, Artificial Sequence
  Synthetic
gccaagcatttaggtgacactatagtgccccgggctcaggcatgcgtttcagagctatgctggaaacagc

SEQ ID NO: 67952 - DNA, 70 bp, Artificial Sequence
  Synthetic
gccaagcatttaggtgacactatagacctatgtgtatcagctaatgtttcagagctatgctggaaacagc

SEQ ID NO: 67953 - DNA, 70 bp, Artificial Sequence
  Synthetic
gccaagcatttaggtgacactatagcaaatcttgctctgttgcccgtttcagagctatgctggaaacagc

SEQ ID NO: 67954 - DNA, 70 bp, Artificial Sequence
  Synthetic
gccaagcatttaggtgacactatagctcctctgaacatcctagaagtttcagagctatgctggaaacagc

SEQ ID NO: 67955 - DNA, 70 bp, Artificial Sequence
  Synthetic
gccaagcatttaggtgacactatagccttatggaggccatgagtggtttcagagctatgctggaaacagc

SEQ ID NO: 67956 - DNA, 70 bp, Artificial Sequence
  Synthetic
gccaagcatttaggtgacactatagtccgaggggccaatttatgagtttcagagctatgctggaaacagc

SEQ ID NO: 67957 - DNA, 70 bp, Artificial Sequence
  Synthetic
gccaagcatttaggtgacactatagtgccgtgatgactcagtggagtttcagagctatgctggaaacagc

SEQ ID NO: 67958 - DNA, 70 bp, Artificial Sequence
  Synthetic
gccaagcatttaggtgacactatagtctatagtggagcatgaaatgtttcagagctatgctggaaacagc

SEQ ID NO: 67959 - DNA, 70 bp, Artificial Sequence
  Synthetic
gccaagcatttaggtgacactatagaggaccgcgccggcgctcacgtttcagagctatgctggaaacagc

SEQ ID NO: 67960 - DNA, 70 bp, Artificial Sequence
  Synthetic
gccaagcatttaggtgacactatagcaggagtgtgtctaatacccgtttcagagctatgctggaaacagc

SEQ ID NO: 67961 - DNA, 70 bp, Artificial Sequence
  Synthetic
gccaagcatttaggtgacactatagggccgcaccgtggatcctacgtttcagagctatgctggaaacagc

SEQ ID NO: 67962 - DNA, 70 bp, Artificial Sequence
  Synthetic
gccaagcatttaggtgacactatagtgctgggctcaagtgtcagcgtttcagagctatgctggaaacagc

SEQ ID NO: 67963 - DNA, 70 bp, Artificial Sequence
  Synthetic
gccaagcatttaggtgacactatagtggaccaggaagtgcaatttgtttcagagctatgctggaaacagc

SEQ ID NO: 67964 - DNA, 70 bp, Artificial Sequence
  Synthetic
gccaagcatttaggtgacactatagccacgtatccgtgggctaccgtttcagagctatgctggaaacagc

SEQ ID NO: 67965 - DNA, 70 bp, Artificial Sequence
  Synthetic
gccaagcatttaggtgacactatagtcagcgagcagaagatgaaagtttcagagctatgctggaaacagc

SEQ ID NO: 67966 - DNA, 70 bp, Artificial Sequence
  Synthetic
gccaagcatttaggtgacactatagagaaattctcagaggactttgtttcagagctatgctggaaacagc

SEQ ID NO: 67967 - DNA, 70 bp, Artificial Sequence
  Synthetic
gccaagcatttaggtgacactatagacagaagattttggtcaagagtttcagagctatgctggaaacagc

SEQ ID NO: 67968 - DNA, 70 bp, Artificial Sequence
  Synthetic
gccaagcatttaggtgacactatagggttatgtggaactatgtgcgtttcagagctatgctggaaacagc

SEQ ID NO: 67969 - DNA, 70 bp, Artificial Sequence
  Synthetic
gccaagcatttaggtgacactatagtcttattgatatgggatcccgtttcagagctatgctggaaacagc

SEQ ID NO: 67970 - DNA, 70 bp, Artificial Sequence
  Synthetic
gccaagcatttaggtgacactatagggtcatctgcgagcgcggctgtttcagagctatgctggaaacagc

SEQ ID NO: 67971 - DNA, 70 bp, Artificial Sequence
  Synthetic
gccaagcatttaggtgacactataggtttctggcacatcagaagtgtttcagagctatgctggaaacagc

SEQ ID NO: 67972 - DNA, 70 bp, Artificial Sequence
  Synthetic
gccaagcatttaggtgacactatagtgggagcagaacaggtgagagtttcagagctatgctggaaacagc

SEQ ID NO: 67973 - DNA, 70 bp, Artificial Sequence
  Synthetic
gccaagcatttaggtgacactatagtaatgagtttctcgagcttggtttcagagctatgctggaaacagc

SEQ ID NO: 67974 - DNA, 70 bp, Artificial Sequence
  Synthetic
gccaagcatttaggtgacactatagccgaaatttgggagcagaaggtttcagagctatgctggaaacagc

SEQ ID NO: 67975 - DNA, 70 bp, Artificial Sequence
  Synthetic
gccaagcatttaggtgacactatagaatgacaattttctggcgcagtttcagagctatgctggaaacagc

SEQ ID NO: 67976 - DNA, 70 bp, Artificial Sequence
  Synthetic
gccaagcatttaggtgacactatagcccaaaagtccctgttcgtggtttcagagctatgctggaaacagc

SEQ ID NO: 67977 - DNA, 70 bp, Artificial Sequence
  Synthetic
gccaagcatttaggtgacactatagcattcctccacctgtgactggtttcagagctatgctggaaacagc

SEQ ID NO: 67978 - DNA, 70 bp, Artificial Sequence
  Synthetic
gccaagcatttaggtgacactatagtgggctctagctgtactactgtttcagagctatgctggaaacagc

SEQ ID NO: 67979 - DNA, 70 bp, Artificial Sequence
  Synthetic
gccaagcatttaggtgacactatagcacagcatctgaattacttcgtttcagagctatgctggaaacagc

SEQ ID NO: 67980 - DNA, 70 bp, Artificial Sequence
  Synthetic
gccaagcatttaggtgacactatagcagaaagaggagaaactgatgtttcagagctatgctggaaacagc

SEQ ID NO: 67981 - DNA, 70 bp, Artificial Sequence
  Synthetic
gccaagcatttaggtgacactatagtctcttcactaagagtaaacgtttcagagctatgctggaaacagc

SEQ ID NO: 67982 - DNA, 70 bp, Artificial Sequence
  Synthetic
gccaagcatttaggtgacactatagaaattgccttcccaacactggtttcagagctatgctggaaacagc

SEQ ID NO: 67983 - DNA, 70 bp, Artificial Sequence
  Synthetic
gccaagcatttaggtgacactatagcctcccgatggtgccctagggtttcagagctatgctggaaacagc

SEQ ID NO: 67984 - DNA, 70 bp, Artificial Sequence
  Synthetic
gccaagcatttaggtgacactatagaccctggtagatggctgacagtttcagagctatgctggaaacagc

SEQ ID NO: 67985 - DNA, 70 bp, Artificial Sequence
  Synthetic
gccaagcatttaggtgacactatagggagtggttaaggcataggcgtttcagagctatgctggaaacagc

SEQ ID NO: 67986 - DNA, 70 bp, Artificial Sequence
  Synthetic
gccaagcatttaggtgacactataggaccatcctcttcttcagacgtttcagagctatgctggaaacagc

SEQ ID NO: 67987 - DNA, 70 bp, Artificial Sequence
  Synthetic
gccaagcatttaggtgacactatagagttcagttgtctctgtagggtttcagagctatgctggaaacagc

SEQ ID NO: 67988 - DNA, 70 bp, Artificial Sequence
  Synthetic
gccaagcatttaggtgacactataggggagaagtcacacgaccatgtttcagagctatgctggaaacagc

SEQ ID NO: 67989 - DNA, 70 bp, Artificial Sequence
  Synthetic
gccaagcatttaggtgacactatagggtagtgaccttcggtgagcgtttcagagctatgctggaaacagc

SEQ ID NO: 67990 - DNA, 70 bp, Artificial Sequence
  Synthetic
gccaagcatttaggtgacactatagacagacacttttgccctcaggtttcagagctatgctggaaacagc

SEQ ID NO: 67991 - DNA, 70 bp, Artificial Sequence
  Synthetic
gccaagcatttaggtgacactatagagaggagagactttcttaccgtttcagagctatgctggaaacagc

SEQ ID NO: 67992 - DNA, 70 bp, Artificial Sequence
  Synthetic
gccaagcatttaggtgacactatagtggcttacttgagatgcatcgtttcagagctatgctggaaacagc

SEQ ID NO: 67993 - DNA, 70 bp, Artificial Sequence
  Synthetic
gccaagcatttaggtgacactataggcgcgcgcgctcacaccaaggtttcagagctatgctggaaacagc

SEQ ID NO: 67994 - DNA, 70 bp, Artificial Sequence
  Synthetic
gccaagcatttaggtgacactatagccctgactctccaaactttggtttcagagctatgctggaaacagc

SEQ ID NO: 67995 - DNA, 70 bp, Artificial Sequence
  Synthetic
gccaagcatttaggtgacactatagcattgacatcagctcatttcgtttcagagctatgctggaaacagc

SEQ ID NO: 67996 - DNA, 70 bp, Artificial Sequence
  Synthetic
gccaagcatttaggtgacactatagcccaggatctcatgaatatggtttcagagctatgctggaaacagc

SEQ ID NO: 67997 - DNA, 70 bp, Artificial Sequence
  Synthetic
gccaagcatttaggtgacactatagctatacgactgacctttctggtttcagagctatgctggaaacagc

SEQ ID NO: 67998 - DNA, 70 bp, Artificial Sequence
  Synthetic
gccaagcatttaggtgacactatagcttgtttgtggctttgtgaagtttcagagctatgctggaaacagc

SEQ ID NO: 67999 - DNA, 70 bp, Artificial Sequence
  Synthetic
gccaagcatttaggtgacactatagtgtagtgaattagagtacaggtttcagagctatgctggaaacagc

SEQ ID NO: 68000 - DNA, 70 bp, Artificial Sequence
  Synthetic
gccaagcatttaggtgacactatagaagttcctgcgcctgctcttgtttcagagctatgctggaaacagc

SEQ ID NO: 68001 - DNA, 70 bp, Artificial Sequence
  Synthetic
gccaagcatttaggtgacactatagtaaaaccgctttattcaggtgtttcagagctatgctggaaacagc

SEQ ID NO: 68002 - DNA, 70 bp, Artificial Sequence
  Synthetic
gccaagcatttaggtgacactatagacagcttgttctcctcgaaggtttcagagctatgctggaaacagc

SEQ ID NO: 68003 - DNA, 70 bp, Artificial Sequence
  Synthetic
gccaagcatttaggtgacactatagtctcacatcaagaactctgcgtttcagagctatgctggaaacagc

SEQ ID NO: 68004 - DNA, 70 bp, Artificial Sequence
  Synthetic
gccaagcatttaggtgacactatagcacaactgaggagattgagcgtttcagagctatgctggaaacagc

SEQ ID NO: 68005 - DNA, 70 bp, Artificial Sequence
  Synthetic
gccaagcatttaggtgacactatagaaggtcatcaggcaccaccagtttcagagctatgctggaaacagc

SEQ ID NO: 68006 - DNA, 70 bp, Artificial Sequence
  Synthetic
gccaagcatttaggtgacactataggagcgtgttggctatagagagtttcagagctatgctggaaacagc

SEQ ID NO: 68007 - DNA, 70 bp, Artificial Sequence
  Synthetic
gccaagcatttaggtgacactataggcattacagggttcagctgagtttcagagctatgctggaaacagc

SEQ ID NO: 68008 - DNA, 70 bp, Artificial Sequence
  Synthetic
gccaagcatttaggtgacactatagtgggacctgtgggtctcatggtttcagagctatgctggaaacagc

SEQ ID NO: 68009 - DNA, 70 bp, Artificial Sequence
  Synthetic
gccaagcatttaggtgacactataggcagctggaggacatggcttgtttcagagctatgctggaaacagc

SEQ ID NO: 68010 - DNA, 70 bp, Artificial Sequence
  Synthetic
gccaagcatttaggtgacactataggctctcaagttactgacgacgtttcagagctatgctggaaacagc

SEQ ID NO: 68011 - DNA, 70 bp, Artificial Sequence
  Synthetic
gccaagcatttaggtgacactatagaggcacattattttagcatcgtttcagagctatgctggaaacagc

SEQ ID NO: 68012 - DNA, 70 bp, Artificial Sequence
  Synthetic
gccaagcatttaggtgacactatagcagaaaaagtgatcgccatcgtttcagagctatgctggaaacagc

SEQ ID NO: 68013 - DNA, 70 bp, Artificial Sequence
  Synthetic
gccaagcatttaggtgacactatagttctgacagggatgttgcgagtttcagagctatgctggaaacagc

SEQ ID NO: 68014 - DNA, 70 bp, Artificial Sequence
  Synthetic
gccaagcatttaggtgacactatagccttccctatagaagttcaagtttcagagctatgctggaaacagc

SEQ ID NO: 68015 - DNA, 70 bp, Artificial Sequence
  Synthetic
gccaagcatttaggtgacactatagtgggctctgactcctacagagtttcagagctatgctggaaacagc

SEQ ID NO: 68016 - DNA, 70 bp, Artificial Sequence
  Synthetic
gccaagcatttaggtgacactataggccagccgtgagccgtaagcgtttcagagctatgctggaaacagc

SEQ ID NO: 68017 - DNA, 70 bp, Artificial Sequence
  Synthetic
gccaagcatttaggtgacactatagacgggagccatgtgcctcaggtttcagagctatgctggaaacagc

SEQ ID NO: 68018 - DNA, 70 bp, Artificial Sequence
  Synthetic
gccaagcatttaggtgacactatagctctaggaaagagtgaccttgtttcagagctatgctggaaacagc

SEQ ID NO: 68019 - DNA, 70 bp, Artificial Sequence
  Synthetic
gccaagcatttaggtgacactatagagcgtccctgagacactttagtttcagagctatgctggaaacagc

SEQ ID NO: 68020 - DNA, 70 bp, Artificial Sequence
  Synthetic
gccaagcatttaggtgacactatagcaacagacagaaacacaggtgtttcagagctatgctggaaacagc

SEQ ID NO: 68021 - DNA, 70 bp, Artificial Sequence
  Synthetic
gccaagcatttaggtgacactatagttctggatggtatcttcaaagtttcagagctatgctggaaacagc

SEQ ID NO: 68022 - DNA, 70 bp, Artificial Sequence
  Synthetic
gccaagcatttaggtgacactataggtttgtgcttctgcggcactgtttcagagctatgctggaaacagc

SEQ ID NO: 68023 - DNA, 70 bp, Artificial Sequence
  Synthetic
gccaagcatttaggtgacactatagacagcccagcgaacgtgtgagtttcagagctatgctggaaacagc

SEQ ID NO: 68024 - DNA, 70 bp, Artificial Sequence
  Synthetic
gccaagcatttaggtgacactatagttctgctaggcctggcctccgtttcagagctatgctggaaacagc

SEQ ID NO: 68025 - DNA, 70 bp, Artificial Sequence
  Synthetic
gccaagcatttaggtgacactataggtgcagctggcaaaggagtagtttcagagctatgctggaaacagc

SEQ ID NO: 68026 - DNA, 70 bp, Artificial Sequence
  Synthetic
gccaagcatttaggtgacactatagttcttagacactcgacaacagtttcagagctatgctggaaacagc

SEQ ID NO: 68027 - DNA, 70 bp, Artificial Sequence
  Synthetic
gccaagcatttaggtgacactatagtgtgcacgagacatgaatgcgtttcagagctatgctggaaacagc

SEQ ID NO: 68028 - DNA, 70 bp, Artificial Sequence
  Synthetic
gccaagcatttaggtgacactatagccaaggcaagcagactgtgtgtttcagagctatgctggaaacagc

SEQ ID NO: 68029 - DNA, 70 bp, Artificial Sequence
  Synthetic
gccaagcatttaggtgacactataggtcgttcctgcaaagcagttgtttcagagctatgctggaaacagc

SEQ ID NO: 68030 - DNA, 70 bp, Artificial Sequence
  Synthetic
gccaagcatttaggtgacactataggaagagtccaccatgtaagggtttcagagctatgctggaaacagc

SEQ ID NO: 68031 - DNA, 70 bp, Artificial Sequence
  Synthetic
gccaagcatttaggtgacactatagtcctgccgcactgaatactcgtttcagagctatgctggaaacagc

SEQ ID NO: 68032 - DNA, 70 bp, Artificial Sequence
  Synthetic
gccaagcatttaggtgacactatagcccaggaagtgcagcaagtggtttcagagctatgctggaaacagc

SEQ ID NO: 68033 - DNA, 70 bp, Artificial Sequence
  Synthetic
gccaagcatttaggtgacactatagttcacatcttcacaccatgagtttcagagctatgctggaaacagc

SEQ ID NO: 68034 - DNA, 70 bp, Artificial Sequence
  Synthetic
gccaagcatttaggtgacactatagtcactctagagatagatttcgtttcagagctatgctggaaacagc

SEQ ID NO: 68035 - DNA, 70 bp, Artificial Sequence
  Synthetic
gccaagcatttaggtgacactatagcgagtgctactgaaagtcgagtttcagagctatgctggaaacagc

SEQ ID NO: 68036 - DNA, 70 bp, Artificial Sequence
  Synthetic
gccaagcatttaggtgacactatagcaggaggtgaagaaattggtgtttcagagctatgctggaaacagc

SEQ ID NO: 68037 - DNA, 70 bp, Artificial Sequence
  Synthetic
gccaagcatttaggtgacactatagctgagaatggactcgggcacgtttcagagctatgctggaaacagc

SEQ ID NO: 68038 - DNA, 70 bp, Artificial Sequence
  Synthetic
gccaagcatttaggtgacactatagtgatgaatgggatgactgaggtttcagagctatgctggaaacagc

SEQ ID NO: 68039 - DNA, 70 bp, Artificial Sequence
  Synthetic
gccaagcatttaggtgacactatagcaacagcaatacggcgagacgtttcagagctatgctggaaacagc

SEQ ID NO: 68040 - DNA, 70 bp, Artificial Sequence
  Synthetic
gccaagcatttaggtgacactatagagcaggcagaaagagttaatgtttcagagctatgctggaaacagc

SEQ ID NO: 68041 - DNA, 70 bp, Artificial Sequence
  Synthetic
gccaagcatttaggtgacactatagttttcagctgcgcagggttggtttcagagctatgctggaaacagc

SEQ ID NO: 68042 - DNA, 70 bp, Artificial Sequence
  Synthetic
gccaagcatttaggtgacactatagtccgccggcctttgctcagtgtttcagagctatgctggaaacagc

SEQ ID NO: 68043 - DNA, 70 bp, Artificial Sequence
  Synthetic
gccaagcatttaggtgacactatagggacgactgggaatcgtagggtttcagagctatgctggaaacagc

SEQ ID NO: 68044 - DNA, 70 bp, Artificial Sequence
  Synthetic
gccaagcatttaggtgacactatagggataccctgtgtgctctacgtttcagagctatgctggaaacagc

SEQ ID NO: 68045 - DNA, 70 bp, Artificial Sequence
  Synthetic
gccaagcatttaggtgacactataggttttctcactttcgccatcgtttcagagctatgctggaaacagc

SEQ ID NO: 68046 - DNA, 70 bp, Artificial Sequence
  Synthetic
gccaagcatttaggtgacactatagcatccgtatcatttcacaacgtttcagagctatgctggaaacagc

SEQ ID NO: 68047 - DNA, 70 bp, Artificial Sequence
  Synthetic
gccaagcatttaggtgacactataggtacacaaagctacccaggagtttcagagctatgctggaaacagc

SEQ ID NO: 68048 - DNA, 70 bp, Artificial Sequence
  Synthetic
gccaagcatttaggtgacactatagttttgaggatgatgatgagtgtttcagagctatgctggaaacagc

SEQ ID NO: 68049 - DNA, 70 bp, Artificial Sequence
  Synthetic
gccaagcatttaggtgacactatagaccctctcaaaactacttatgtttcagagctatgctggaaacagc

SEQ ID NO: 68050 - DNA, 70 bp, Artificial Sequence
  Synthetic
gccaagcatttaggtgacactataggctttcatgaaagagatggagtttcagagctatgctggaaacagc

SEQ ID NO: 68051 - DNA, 70 bp, Artificial Sequence
  Synthetic
gccaagcatttaggtgacactatagctggcaggacctgctctagcgtttcagagctatgctggaaacagc

SEQ ID NO: 68052 - DNA, 70 bp, Artificial Sequence
  Synthetic
gccaagcatttaggtgacactatagagggaggcaggagggcctacgtttcagagctatgctggaaacagc

SEQ ID NO: 68053 - DNA, 70 bp, Artificial Sequence
  Synthetic
gccaagcatttaggtgacactatagtccctctgcctcctcttctcgtttcagagctatgctggaaacagc

SEQ ID NO: 68054 - DNA, 70 bp, Artificial Sequence
  Synthetic
gccaagcatttaggtgacactatagtctagaaatttaaggcaacggtttcagagctatgctggaaacagc

SEQ ID NO: 68055 - DNA, 70 bp, Artificial Sequence
  Synthetic
gccaagcatttaggtgacactatagtgtgtggctgtgaaggttaagtttcagagctatgctggaaacagc

SEQ ID NO: 68056 - DNA, 70 bp, Artificial Sequence
  Synthetic
gccaagcatttaggtgacactatagttgtaaccatgtagatggcagtttcagagctatgctggaaacagc

SEQ ID NO: 68057 - DNA, 70 bp, Artificial Sequence
  Synthetic
gccaagcatttaggtgacactataggcccagctctcagatcagtggtttcagagctatgctggaaacagc

SEQ ID NO: 68058 - DNA, 70 bp, Artificial Sequence
  Synthetic
gccaagcatttaggtgacactataggagagtcatcaagacacgacgtttcagagctatgctggaaacagc

SEQ ID NO: 68059 - DNA, 70 bp, Artificial Sequence
  Synthetic
gccaagcatttaggtgacactatagatgagagaggttcagaagatgtttcagagctatgctggaaacagc

SEQ ID NO: 68060 - DNA, 70 bp, Artificial Sequence
  Synthetic
gccaagcatttaggtgacactatagctgctggtctgcagatgggtgtttcagagctatgctggaaacagc

SEQ ID NO: 68061 - DNA, 70 bp, Artificial Sequence
  Synthetic
gccaagcatttaggtgacactatagttgcatttaagcaggagtaagtttcagagctatgctggaaacagc

SEQ ID NO: 68062 - DNA, 70 bp, Artificial Sequence
  Synthetic
gccaagcatttaggtgacactatagcaacaaaaattagctgggtggtttcagagctatgctggaaacagc

SEQ ID NO: 68063 - DNA, 70 bp, Artificial Sequence
  Synthetic
gccaagcatttaggtgacactataggagagaagacggcagagaacgtttcagagctatgctggaaacagc

SEQ ID NO: 68064 - DNA, 70 bp, Artificial Sequence
  Synthetic
gccaagcatttaggtgacactatagcgggggtggggctcctcagtgtttcagagctatgctggaaacagc

SEQ ID NO: 68065 - DNA, 70 bp, Artificial Sequence
  Synthetic
gccaagcatttaggtgacactatagattaagctgtcactcttcaagtttcagagctatgctggaaacagc

SEQ ID NO: 68066 - DNA, 70 bp, Artificial Sequence
  Synthetic
gccaagcatttaggtgacactatagttcactttcatgccccaacagtttcagagctatgctggaaacagc

SEQ ID NO: 68067 - DNA, 70 bp, Artificial Sequence
  Synthetic
gccaagcatttaggtgacactatagtggaggcgggagcagaagtagtttcagagctatgctggaaacagc

SEQ ID NO: 68068 - DNA, 70 bp, Artificial Sequence
  Synthetic
gccaagcatttaggtgacactatagccattctcacctttagggacgtttcagagctatgctggaaacagc

SEQ ID NO: 68069 - DNA, 70 bp, Artificial Sequence
  Synthetic
gccaagcatttaggtgacactatagcggggtctccgggcctcactgtttcagagctatgctggaaacagc

SEQ ID NO: 68070 - DNA, 70 bp, Artificial Sequence
  Synthetic
gccaagcatttaggtgacactatagaacggaggaggaactgtgatgtttcagagctatgctggaaacagc

SEQ ID NO: 68071 - DNA, 70 bp, Artificial Sequence
  Synthetic
gccaagcatttaggtgacactatagagatatagaagtacagctccgtttcagagctatgctggaaacagc

SEQ ID NO: 68072 - DNA, 70 bp, Artificial Sequence
  Synthetic
gccaagcatttaggtgacactatagatggggaaggcctggtaaaggtttcagagctatgctggaaacagc

SEQ ID NO: 68073 - DNA, 70 bp, Artificial Sequence
  Synthetic
gccaagcatttaggtgacactatagcgctacactacagttccaccgtttcagagctatgctggaaacagc

SEQ ID NO: 68074 - DNA, 70 bp, Artificial Sequence
  Synthetic
gccaagcatttaggtgacactatagctgttgggcacttttagttcgtttcagagctatgctggaaacagc

SEQ ID NO: 68075 - DNA, 70 bp, Artificial Sequence
  Synthetic
gccaagcatttaggtgacactatagtttgcttcctgagcttgtctgtttcagagctatgctggaaacagc

SEQ ID NO: 68076 - DNA, 70 bp, Artificial Sequence
  Synthetic
gccaagcatttaggtgacactatagctctgcgagtactcctgacggtttcagagctatgctggaaacagc

SEQ ID NO: 68077 - DNA, 70 bp, Artificial Sequence
  Synthetic
gccaagcatttaggtgacactatagggggaggggacatgaagatcgtttcagagctatgctggaaacagc

SEQ ID NO: 68078 - DNA, 70 bp, Artificial Sequence
  Synthetic
gccaagcatttaggtgacactataggcagtagcatggatagttgagtttcagagctatgctggaaacagc

SEQ ID NO: 68079 - DNA, 70 bp, Artificial Sequence
  Synthetic
gccaagcatttaggtgacactataggttactcagctagaaagagcgtttcagagctatgctggaaacagc

SEQ ID NO: 68080 - DNA, 70 bp, Artificial Sequence
  Synthetic
gccaagcatttaggtgacactatagttccccttttttctctgctggtttcagagctatgctggaaacagc

SEQ ID NO: 68081 - DNA, 70 bp, Artificial Sequence
  Synthetic
gccaagcatttaggtgacactataggaagaggaagaggaaaaagagtttcagagctatgctggaaacagc

SEQ ID NO: 68082 - DNA, 70 bp, Artificial Sequence
  Synthetic
gccaagcatttaggtgacactatagcaggaagtggcagcattctggtttcagagctatgctggaaacagc

SEQ ID NO: 68083 - DNA, 70 bp, Artificial Sequence
  Synthetic
gccaagcatttaggtgacactatagcacggggtggtggaaggggtgtttcagagctatgctggaaacagc

SEQ ID NO: 68084 - DNA, 70 bp, Artificial Sequence
  Synthetic
gccaagcatttaggtgacactatagctgtctgccgcattttgcacgtttcagagctatgctggaaacagc

SEQ ID NO: 68085 - DNA, 70 bp, Artificial Sequence
  Synthetic
gccaagcatttaggtgacactataggttacttcctttctgtcaaggtttcagagctatgctggaaacagc

SEQ ID NO: 68086 - DNA, 70 bp, Artificial Sequence
  Synthetic
gccaagcatttaggtgacactatagagcagaggtggcggcctgaggtttcagagctatgctggaaacagc

SEQ ID NO: 68087 - DNA, 70 bp, Artificial Sequence
  Synthetic
gccaagcatttaggtgacactataggccatagtccagtgggataagtttcagagctatgctggaaacagc

SEQ ID NO: 68088 - DNA, 70 bp, Artificial Sequence
  Synthetic
gccaagcatttaggtgacactatagcatcccaggtggaagaaaacgtttcagagctatgctggaaacagc

SEQ ID NO: 68089 - DNA, 70 bp, Artificial Sequence
  Synthetic
gccaagcatttaggtgacactataggatgttgatgttccaaccaagtttcagagctatgctggaaacagc

SEQ ID NO: 68090 - DNA, 70 bp, Artificial Sequence
  Synthetic
gccaagcatttaggtgacactatagggtggttggtgttaggtttggtttcagagctatgctggaaacagc

SEQ ID NO: 68091 - DNA, 70 bp, Artificial Sequence
  Synthetic
gccaagcatttaggtgacactatagcaacttagcgtcgcctccccgtttcagagctatgctggaaacagc

SEQ ID NO: 68092 - DNA, 70 bp, Artificial Sequence
  Synthetic
gccaagcatttaggtgacactatagattccttaaactagacagcagtttcagagctatgctggaaacagc

SEQ ID NO: 68093 - DNA, 70 bp, Artificial Sequence
  Synthetic
gccaagcatttaggtgacactatagaaaagatgaagaaaatggcggtttcagagctatgctggaaacagc

SEQ ID NO: 68094 - DNA, 70 bp, Artificial Sequence
  Synthetic
gccaagcatttaggtgacactatagcttctctctgctgacttcacgtttcagagctatgctggaaacagc

SEQ ID NO: 68095 - DNA, 70 bp, Artificial Sequence
  Synthetic
gccaagcatttaggtgacactatagcatcatcatcacagatgtcagtttcagagctatgctggaaacagc

SEQ ID NO: 68096 - DNA, 70 bp, Artificial Sequence
  Synthetic
gccaagcatttaggtgacactatagctggagtcacagcttgtcatgtttcagagctatgctggaaacagc

SEQ ID NO: 68097 - DNA, 70 bp, Artificial Sequence
  Synthetic
gccaagcatttaggtgacactatagctcagcgcacaaatctgtccgtttcagagctatgctggaaacagc

SEQ ID NO: 68098 - DNA, 70 bp, Artificial Sequence
  Synthetic
gccaagcatttaggtgacactatagtcaccctctggacttacaatgtttcagagctatgctggaaacagc

SEQ ID NO: 68099 - DNA, 70 bp, Artificial Sequence
  Synthetic
gccaagcatttaggtgacactataggcattagcccagccttcacggtttcagagctatgctggaaacagc

SEQ ID NO: 68100 - DNA, 70 bp, Artificial Sequence
  Synthetic
gccaagcatttaggtgacactatagttcatgatgcagaatttcctgtttcagagctatgctggaaacagc

SEQ ID NO: 68101 - DNA, 70 bp, Artificial Sequence
  Synthetic
gccaagcatttaggtgacactataggtcattttctagcgcagcaggtttcagagctatgctggaaacagc

SEQ ID NO: 68102 - DNA, 70 bp, Artificial Sequence
  Synthetic
gccaagcatttaggtgacactataggaaaaagtgaactggctcttgtttcagagctatgctggaaacagc

SEQ ID NO: 68103 - DNA, 70 bp, Artificial Sequence
  Synthetic
gccaagcatttaggtgacactatagtctaagtgggatttgctaacgtttcagagctatgctggaaacagc

SEQ ID NO: 68104 - DNA, 70 bp, Artificial Sequence
  Synthetic
gccaagcatttaggtgacactatagctcacacactgctgaatctcgtttcagagctatgctggaaacagc

SEQ ID NO: 68105 - DNA, 70 bp, Artificial Sequence
  Synthetic
gccaagcatttaggtgacactatagggcaactcctttgctgtgacgtttcagagctatgctggaaacagc

SEQ ID NO: 68106 - DNA, 70 bp, Artificial Sequence
  Synthetic
gccaagcatttaggtgacactatagctggggatgacagtgactgagtttcagagctatgctggaaacagc

SEQ ID NO: 68107 - DNA, 70 bp, Artificial Sequence
  Synthetic
gccaagcatttaggtgacactataggttctgcatcattgtctagagtttcagagctatgctggaaacagc

SEQ ID NO: 68108 - DNA, 70 bp, Artificial Sequence
  Synthetic
gccaagcatttaggtgacactatagtgcatctccctgactcacctgtttcagagctatgctggaaacagc

SEQ ID NO: 68109 - DNA, 70 bp, Artificial Sequence
  Synthetic
gccaagcatttaggtgacactatagttcagaaagtgctttcaagcgtttcagagctatgctggaaacagc

SEQ ID NO: 68110 - DNA, 70 bp, Artificial Sequence
  Synthetic
gccaagcatttaggtgacactatagctaatgctgctgatgcgatggtttcagagctatgctggaaacagc

SEQ ID NO: 68111 - DNA, 70 bp, Artificial Sequence
  Synthetic
gccaagcatttaggtgacactataggtttacaactggtatgactggtttcagagctatgctggaaacagc

SEQ ID NO: 68112 - DNA, 70 bp, Artificial Sequence
  Synthetic
gccaagcatttaggtgacactataggggaaaactgcacaagtagcgtttcagagctatgctggaaacagc

SEQ ID NO: 68113 - DNA, 70 bp, Artificial Sequence
  Synthetic
gccaagcatttaggtgacactatagtgtgtctgttggagatgaccgtttcagagctatgctggaaacagc

SEQ ID NO: 68114 - DNA, 70 bp, Artificial Sequence
  Synthetic
gccaagcatttaggtgacactatagggaaggcacgggggcactgagtttcagagctatgctggaaacagc

SEQ ID NO: 68115 - DNA, 70 bp, Artificial Sequence
  Synthetic
gccaagcatttaggtgacactatagagagaaggggtcatacatgggtttcagagctatgctggaaacagc

SEQ ID NO: 68116 - DNA, 70 bp, Artificial Sequence
  Synthetic
gccaagcatttaggtgacactatagttcccagctatacccaagtagtttcagagctatgctggaaacagc

SEQ ID NO: 68117 - DNA, 70 bp, Artificial Sequence
  Synthetic
gccaagcatttaggtgacactatagggtaacttcactgaccatccgtttcagagctatgctggaaacagc

SEQ ID NO: 68118 - DNA, 70 bp, Artificial Sequence
  Synthetic
gccaagcatttaggtgacactatagtagcttcttgatgtgtctgagtttcagagctatgctggaaacagc

SEQ ID NO: 68119 - DNA, 70 bp, Artificial Sequence
  Synthetic
gccaagcatttaggtgacactatagagcagcattagaccatgaaggtttcagagctatgctggaaacagc

SEQ ID NO: 68120 - DNA, 70 bp, Artificial Sequence
  Synthetic
gccaagcatttaggtgacactatagaagcaaagaatgagccagaagtttcagagctatgctggaaacagc

SEQ ID NO: 68121 - DNA, 70 bp, Artificial Sequence
  Synthetic
gccaagcatttaggtgacactatagaacagcaagtcaaagaatcagtttcagagctatgctggaaacagc

SEQ ID NO: 68122 - DNA, 70 bp, Artificial Sequence
  Synthetic
gccaagcatttaggtgacactatagcccctgcaaggtgtcttaaagtttcagagctatgctggaaacagc

SEQ ID NO: 68123 - DNA, 70 bp, Artificial Sequence
  Synthetic
gccaagcatttaggtgacactatagtggaaagatgctggtgtcaggtttcagagctatgctggaaacagc

SEQ ID NO: 68124 - DNA, 70 bp, Artificial Sequence
  Synthetic
gccaagcatttaggtgacactatagagtgggcacaggggcgtcaggtttcagagctatgctggaaacagc

SEQ ID NO: 68125 - DNA, 70 bp, Artificial Sequence
  Synthetic
gccaagcatttaggtgacactatagtccccatctccaaggcttaagtttcagagctatgctggaaacagc

SEQ ID NO: 68126 - DNA, 70 bp, Artificial Sequence
  Synthetic
gccaagcatttaggtgacactatagaaaaacatgtatcttcccgcgtttcagagctatgctggaaacagc

SEQ ID NO: 68127 - DNA, 70 bp, Artificial Sequence
  Synthetic
gccaagcatttaggtgacactataggcaagtgttactgagtagatgtttcagagctatgctggaaacagc

SEQ ID NO: 68128 - DNA, 70 bp, Artificial Sequence
  Synthetic
gccaagcatttaggtgacactatagtattcttgtttgggttaccagtttcagagctatgctggaaacagc

SEQ ID NO: 68129 - DNA, 70 bp, Artificial Sequence
  Synthetic
gccaagcatttaggtgacactatagttatgctgattggtttgactgtttcagagctatgctggaaacagc

SEQ ID NO: 68130 - DNA, 70 bp, Artificial Sequence
  Synthetic
gccaagcatttaggtgacactatagctcctgcctcagtctatgccgtttcagagctatgctggaaacagc

SEQ ID NO: 68131 - DNA, 70 bp, Artificial Sequence
  Synthetic
gccaagcatttaggtgacactataggcaacagggtcagtcatcaagtttcagagctatgctggaaacagc

SEQ ID NO: 68132 - DNA, 70 bp, Artificial Sequence
  Synthetic
gccaagcatttaggtgacactatagtatgaggcagaggatggagcgtttcagagctatgctggaaacagc

SEQ ID NO: 68133 - DNA, 70 bp, Artificial Sequence
  Synthetic
gccaagcatttaggtgacactatagcttctaggctggtatcaccagtttcagagctatgctggaaacagc

SEQ ID NO: 68134 - DNA, 70 bp, Artificial Sequence
  Synthetic
gccaagcatttaggtgacactatagcccccttttcccttttaggggtttcagagctatgctggaaacagc

SEQ ID NO: 68135 - DNA, 70 bp, Artificial Sequence
  Synthetic
gccaagcatttaggtgacactatagctccctccccatccctgaccgtttcagagctatgctggaaacagc

SEQ ID NO: 68136 - DNA, 70 bp, Artificial Sequence
  Synthetic
gccaagcatttaggtgacactatagggggccccgcgggatcaggcgtttcagagctatgctggaaacagc

SEQ ID NO: 68137 - DNA, 70 bp, Artificial Sequence
  Synthetic
gccaagcatttaggtgacactataggttgctcccactctctaattgtttcagagctatgctggaaacagc

SEQ ID NO: 68138 - DNA, 70 bp, Artificial Sequence
  Synthetic
gccaagcatttaggtgacactatagaccgccgccaaggggaagcagtttcagagctatgctggaaacagc

SEQ ID NO: 68139 - DNA, 70 bp, Artificial Sequence
  Synthetic
gccaagcatttaggtgacactatagtactatgaactcgtactcgtgtttcagagctatgctggaaacagc

SEQ ID NO: 68140 - DNA, 70 bp, Artificial Sequence
  Synthetic
gccaagcatttaggtgacactatagcagtccctgctgcatctcaggtttcagagctatgctggaaacagc

SEQ ID NO: 68141 - DNA, 70 bp, Artificial Sequence
  Synthetic
gccaagcatttaggtgacactataggggcaagtcatcaggctttagtttcagagctatgctggaaacagc

SEQ ID NO: 68142 - DNA, 70 bp, Artificial Sequence
  Synthetic
gccaagcatttaggtgacactatagggcagacttactacttccaggtttcagagctatgctggaaacagc

SEQ ID NO: 68143 - DNA, 70 bp, Artificial Sequence
  Synthetic
gccaagcatttaggtgacactatagcgatcagtactctcaccgttgtttcagagctatgctggaaacagc

SEQ ID NO: 68144 - DNA, 70 bp, Artificial Sequence
  Synthetic
gccaagcatttaggtgacactatagagagagaacttcaagaagtggtttcagagctatgctggaaacagc

SEQ ID NO: 68145 - DNA, 70 bp, Artificial Sequence
  Synthetic
gccaagcatttaggtgacactatagacctgtaaatgaggctaaaagtttcagagctatgctggaaacagc

SEQ ID NO: 68146 - DNA, 70 bp, Artificial Sequence
  Synthetic
gccaagcatttaggtgacactatagccctgacacctacagctgacgtttcagagctatgctggaaacagc

SEQ ID NO: 68147 - DNA, 70 bp, Artificial Sequence
  Synthetic
gccaagcatttaggtgacactatagaatggccatcaatagatggcgtttcagagctatgctggaaacagc

SEQ ID NO: 68148 - DNA, 70 bp, Artificial Sequence
  Synthetic
gccaagcatttaggtgacactatagccagggctggagggtctagcgtttcagagctatgctggaaacagc

SEQ ID NO: 68149 - DNA, 70 bp, Artificial Sequence
  Synthetic
gccaagcatttaggtgacactatagtccgaatttacacatcggttgtttcagagctatgctggaaacagc

SEQ ID NO: 68150 - DNA, 70 bp, Artificial Sequence
  Synthetic
gccaagcatttaggtgacactatagatatagtaaggctgacagaggtttcagagctatgctggaaacagc

SEQ ID NO: 68151 - DNA, 70 bp, Artificial Sequence
  Synthetic
gccaagcatttaggtgacactatagagcgtgagcctctgcattaagtttcagagctatgctggaaacagc

SEQ ID NO: 68152 - DNA, 70 bp, Artificial Sequence
  Synthetic
gccaagcatttaggtgacactatagtgcttctgttgtccccttccgtttcagagctatgctggaaacagc

SEQ ID NO: 68153 - DNA, 70 bp, Artificial Sequence
  Synthetic
gccaagcatttaggtgacactatagtgcatgagcatcctgtgagtgtttcagagctatgctggaaacagc

SEQ ID NO: 68154 - DNA, 70 bp, Artificial Sequence
  Synthetic
gccaagcatttaggtgacactataggaggataccgtgacaagatggtttcagagctatgctggaaacagc

SEQ ID NO: 68155 - DNA, 70 bp, Artificial Sequence
  Synthetic
gccaagcatttaggtgacactatagtgtatgagcatcctatgagtgtttcagagctatgctggaaacagc

SEQ ID NO: 68156 - DNA, 70 bp, Artificial Sequence
  Synthetic
gccaagcatttaggtgacactatagacggttttagtaatctccacgtttcagagctatgctggaaacagc

SEQ ID NO: 68157 - DNA, 70 bp, Artificial Sequence
  Synthetic
gccaagcatttaggtgacactatagaggacccagcatcatttctggtttcagagctatgctggaaacagc

SEQ ID NO: 68158 - DNA, 70 bp, Artificial Sequence
  Synthetic
gccaagcatttaggtgacactatagtctaggaaatatgcctcagtgtttcagagctatgctggaaacagc

SEQ ID NO: 68159 - DNA, 70 bp, Artificial Sequence
  Synthetic
gccaagcatttaggtgacactatagtcagaaattgggagtgacacgtttcagagctatgctggaaacagc

SEQ ID NO: 68160 - DNA, 70 bp, Artificial Sequence
  Synthetic
gccaagcatttaggtgacactatagaatcagcacagctagggcacgtttcagagctatgctggaaacagc

SEQ ID NO: 68161 - DNA, 70 bp, Artificial Sequence
  Synthetic
gccaagcatttaggtgacactataggattgccgggatcctgccaggtttcagagctatgctggaaacagc

SEQ ID NO: 68162 - DNA, 70 bp, Artificial Sequence
  Synthetic
gccaagcatttaggtgacactataggttattcaagctcctccttagtttcagagctatgctggaaacagc

SEQ ID NO: 68163 - DNA, 70 bp, Artificial Sequence
  Synthetic
gccaagcatttaggtgacactatagacattgtggactgaaatgtagtttcagagctatgctggaaacagc

SEQ ID NO: 68164 - DNA, 70 bp, Artificial Sequence
  Synthetic
gccaagcatttaggtgacactatagtctacttactattcaacgtcgtttcagagctatgctggaaacagc

SEQ ID NO: 68165 - DNA, 70 bp, Artificial Sequence
  Synthetic
gccaagcatttaggtgacactataggatcggccaatagaatctaggtttcagagctatgctggaaacagc

SEQ ID NO: 68166 - DNA, 70 bp, Artificial Sequence
  Synthetic
gccaagcatttaggtgacactataggcccctgcgggggctagtccgtttcagagctatgctggaaacagc

SEQ ID NO: 68167 - DNA, 70 bp, Artificial Sequence
  Synthetic
gccaagcatttaggtgacactataggacgtcctcaaggagtttctgtttcagagctatgctggaaacagc

SEQ ID NO: 68168 - DNA, 70 bp, Artificial Sequence
  Synthetic
gccaagcatttaggtgacactatagccattcctgtcggcggcctggtttcagagctatgctggaaacagc

SEQ ID NO: 68169 - DNA, 70 bp, Artificial Sequence
  Synthetic
gccaagcatttaggtgacactatagccctggccagtgggatggttgtttcagagctatgctggaaacagc

SEQ ID NO: 68170 - DNA, 70 bp, Artificial Sequence
  Synthetic
gccaagcatttaggtgacactatagagttcaatgtgatgctctaggtttcagagctatgctggaaacagc

SEQ ID NO: 68171 - DNA, 70 bp, Artificial Sequence
  Synthetic
gccaagcatttaggtgacactatagcacctgaatccaattacatcgtttcagagctatgctggaaacagc

SEQ ID NO: 68172 - DNA, 70 bp, Artificial Sequence
  Synthetic
gccaagcatttaggtgacactatagagagcaggcaaagatcacctgtttcagagctatgctggaaacagc

SEQ ID NO: 68173 - DNA, 70 bp, Artificial Sequence
  Synthetic
gccaagcatttaggtgacactatagagccaggcttcacctgagaagtttcagagctatgctggaaacagc

SEQ ID NO: 68174 - DNA, 70 bp, Artificial Sequence
  Synthetic
gccaagcatttaggtgacactatagcagagctctgatgacatcaagtttcagagctatgctggaaacagc

SEQ ID NO: 68175 - DNA, 70 bp, Artificial Sequence
  Synthetic
gccaagcatttaggtgacactatagttgtgccgtggaaatcagaagtttcagagctatgctggaaacagc

SEQ ID NO: 68176 - DNA, 70 bp, Artificial Sequence
  Synthetic
gccaagcatttaggtgacactatagagcacccgcccatgattcttgtttcagagctatgctggaaacagc

SEQ ID NO: 68177 - DNA, 70 bp, Artificial Sequence
  Synthetic
gccaagcatttaggtgacactataggtggagtttgcatggacaatgtttcagagctatgctggaaacagc

SEQ ID NO: 68178 - DNA, 70 bp, Artificial Sequence
  Synthetic
gccaagcatttaggtgacactatagtcagaaattgccaactaggcgtttcagagctatgctggaaacagc

SEQ ID NO: 68179 - DNA, 70 bp, Artificial Sequence
  Synthetic
gccaagcatttaggtgacactatagaccaggcagcgtgttaatatgtttcagagctatgctggaaacagc

SEQ ID NO: 68180 - DNA, 70 bp, Artificial Sequence
  Synthetic
gccaagcatttaggtgacactatagattcccagcccggctctagagtttcagagctatgctggaaacagc

SEQ ID NO: 68181 - DNA, 70 bp, Artificial Sequence
  Synthetic
gccaagcatttaggtgacactatagagctcagaaaatatatctccgtttcagagctatgctggaaacagc

SEQ ID NO: 68182 - DNA, 70 bp, Artificial Sequence
  Synthetic
gccaagcatttaggtgacactatagggcacagacagcggcggcaggtttcagagctatgctggaaacagc

SEQ ID NO: 68183 - DNA, 70 bp, Artificial Sequence
  Synthetic
gccaagcatttaggtgacactatagatcaatgacaacgcagcttcgtttcagagctatgctggaaacagc

SEQ ID NO: 68184 - DNA, 70 bp, Artificial Sequence
  Synthetic
gccaagcatttaggtgacactatagcaaggaggcccaggagtagggtttcagagctatgctggaaacagc

SEQ ID NO: 68185 - DNA, 70 bp, Artificial Sequence
  Synthetic
gccaagcatttaggtgacactatagttaatgtctctaggtctaaggtttcagagctatgctggaaacagc

SEQ ID NO: 68186 - DNA, 70 bp, Artificial Sequence
  Synthetic
gccaagcatttaggtgacactataggcgtctaggcggggtcagtcgtttcagagctatgctggaaacagc

SEQ ID NO: 68187 - DNA, 70 bp, Artificial Sequence
  Synthetic
gccaagcatttaggtgacactatagttcagaccctgttcgctcctgtttcagagctatgctggaaacagc

SEQ ID NO: 68188 - DNA, 70 bp, Artificial Sequence
  Synthetic
gccaagcatttaggtgacactatagactctgattcatttaggaccgtttcagagctatgctggaaacagc

SEQ ID NO: 68189 - DNA, 70 bp, Artificial Sequence
  Synthetic
gccaagcatttaggtgacactatagcattcgccggggatgttggcgtttcagagctatgctggaaacagc

SEQ ID NO: 68190 - DNA, 70 bp, Artificial Sequence
  Synthetic
gccaagcatttaggtgacactataggtactgcacgagtgtctgtggtttcagagctatgctggaaacagc

SEQ ID NO: 68191 - DNA, 70 bp, Artificial Sequence
  Synthetic
gccaagcatttaggtgacactatagggtcagcgtctgcaagtgaggtttcagagctatgctggaaacagc

SEQ ID NO: 68192 - DNA, 70 bp, Artificial Sequence
  Synthetic
gccaagcatttaggtgacactataggggtgaatgtgtgtaagtgagtttcagagctatgctggaaacagc

SEQ ID NO: 68193 - DNA, 70 bp, Artificial Sequence
  Synthetic
gccaagcatttaggtgacactataggagcgctatgtctgcaagtggtttcagagctatgctggaaacagc

SEQ ID NO: 68194 - DNA, 70 bp, Artificial Sequence
  Synthetic
gccaagcatttaggtgacactatagggagtggttacttgcaagtggtttcagagctatgctggaaacagc

SEQ ID NO: 68195 - DNA, 70 bp, Artificial Sequence
  Synthetic
gccaagcatttaggtgacactatagcgcctgctggggtcatgtaggtttcagagctatgctggaaacagc

SEQ ID NO: 68196 - DNA, 70 bp, Artificial Sequence
  Synthetic
gccaagcatttaggtgacactatagggtatctgtgtgttcaggttgtttcagagctatgctggaaacagc

SEQ ID NO: 68197 - DNA, 70 bp, Artificial Sequence
  Synthetic
gccaagcatttaggtgacactataggacgtgcacacctgcaagtagtttcagagctatgctggaaacagc

SEQ ID NO: 68198 - DNA, 70 bp, Artificial Sequence
  Synthetic
gccaagcatttaggtgacactatagcgacgtgcacacctgcaagtgtttcagagctatgctggaaacagc

SEQ ID NO: 68199 - DNA, 70 bp, Artificial Sequence
  Synthetic
gccaagcatttaggtgacactatagagggctaggcaggcggtcatgtttcagagctatgctggaaacagc

SEQ ID NO: 68200 - DNA, 70 bp, Artificial Sequence
  Synthetic
gccaagcatttaggtgacactatagccagtttgtgtgcaagtagtgtttcagagctatgctggaaacagc

SEQ ID NO: 68201 - DNA, 70 bp, Artificial Sequence
  Synthetic
gccaagcatttaggtgacactatagcagtacatctgtaaatagccgtttcagagctatgctggaaacagc

SEQ ID NO: 68202 - DNA, 70 bp, Artificial Sequence
  Synthetic
gccaagcatttaggtgacactataggcggccgggcggcgggtcacgtttcagagctatgctggaaacagc

SEQ ID NO: 68203 - DNA, 70 bp, Artificial Sequence
  Synthetic
gccaagcatttaggtgacactatagcaacacgtgcagcgagcgcagtttcagagctatgctggaaacagc

SEQ ID NO: 68204 - DNA, 70 bp, Artificial Sequence
  Synthetic
gccaagcatttaggtgacactataggaggtcttcacctgcaagtggtttcagagctatgctggaaacagc

SEQ ID NO: 68205 - DNA, 70 bp, Artificial Sequence
  Synthetic
gccaagcatttaggtgacactatagagtgcccagtccctgggtaagtttcagagctatgctggaaacagc

SEQ ID NO: 68206 - DNA, 70 bp, Artificial Sequence
  Synthetic
gccaagcatttaggtgacactatagcagcatagatttgtagccacgtttcagagctatgctggaaacagc

SEQ ID NO: 68207 - DNA, 70 bp, Artificial Sequence
  Synthetic
gccaagcatttaggtgacactatagaacccgggagaaaaccctaagtttcagagctatgctggaaacagc

SEQ ID NO: 68208 - DNA, 70 bp, Artificial Sequence
  Synthetic
gccaagcatttaggtgacactatagcctgggaactcagcccttgcgtttcagagctatgctggaaacagc

SEQ ID NO: 68209 - DNA, 70 bp, Artificial Sequence
  Synthetic
gccaagcatttaggtgacactatagtctcagctgcctgagtaactgtttcagagctatgctggaaacagc

SEQ ID NO: 68210 - DNA, 70 bp, Artificial Sequence
  Synthetic
gccaagcatttaggtgacactatagtgtgtacacctgcaagcactgtttcagagctatgctggaaacagc

SEQ ID NO: 68211 - DNA, 70 bp, Artificial Sequence
  Synthetic
gccaagcatttaggtgacactataggtgggtgagctgatataaaagtttcagagctatgctggaaacagc

SEQ ID NO: 68212 - DNA, 70 bp, Artificial Sequence
  Synthetic
gccaagcatttaggtgacactatagtagtgcaccgctgctacgtggtttcagagctatgctggaaacagc

SEQ ID NO: 68213 - DNA, 70 bp, Artificial Sequence
  Synthetic
gccaagcatttaggtgacactatagcttcatccgttcagctgaacgtttcagagctatgctggaaacagc

SEQ ID NO: 68214 - DNA, 70 bp, Artificial Sequence
  Synthetic
gccaagcatttaggtgacactatagattctgttgagtttggtttggtttcagagctatgctggaaacagc

SEQ ID NO: 68215 - DNA, 70 bp, Artificial Sequence
  Synthetic
gccaagcatttaggtgacactatagggaggtctttttagttaagcgtttcagagctatgctggaaacagc

SEQ ID NO: 68216 - DNA, 70 bp, Artificial Sequence
  Synthetic
gccaagcatttaggtgacactatagtagatttcttcaagcagagggtttcagagctatgctggaaacagc

SEQ ID NO: 68217 - DNA, 70 bp, Artificial Sequence
  Synthetic
gccaagcatttaggtgacactataggccgattccttccaagctttgtttcagagctatgctggaaacagc

SEQ ID NO: 68218 - DNA, 70 bp, Artificial Sequence
  Synthetic
gccaagcatttaggtgacactatagtgaaagagttcctcacatacgtttcagagctatgctggaaacagc

SEQ ID NO: 68219 - DNA, 70 bp, Artificial Sequence
  Synthetic
gccaagcatttaggtgacactatagggagtatgtgcccagatgatgtttcagagctatgctggaaacagc

SEQ ID NO: 68220 - DNA, 70 bp, Artificial Sequence
  Synthetic
gccaagcatttaggtgacactatagcctgtgtggacgcatcatctgtttcagagctatgctggaaacagc

SEQ ID NO: 68221 - DNA, 70 bp, Artificial Sequence
  Synthetic
gccaagcatttaggtgacactatagactccagctggcgctttgaggtttcagagctatgctggaaacagc

SEQ ID NO: 68222 - DNA, 70 bp, Artificial Sequence
  Synthetic
gccaagcatttaggtgacactatagggactcaagtgtaaatgtacgtttcagagctatgctggaaacagc

SEQ ID NO: 68223 - DNA, 70 bp, Artificial Sequence
  Synthetic
gccaagcatttaggtgacactatagaagtgtctacatgttctagagtttcagagctatgctggaaacagc

SEQ ID NO: 68224 - DNA, 70 bp, Artificial Sequence
  Synthetic
gccaagcatttaggtgacactatagcctggaagtttacgcctgatgtttcagagctatgctggaaacagc

SEQ ID NO: 68225 - DNA, 70 bp, Artificial Sequence
  Synthetic
gccaagcatttaggtgacactatagcatcattgctgcctgtctcggtttcagagctatgctggaaacagc

SEQ ID NO: 68226 - DNA, 70 bp, Artificial Sequence
  Synthetic
gccaagcatttaggtgacactatagcacgtcactgagctctgagcgtttcagagctatgctggaaacagc

SEQ ID NO: 68227 - DNA, 70 bp, Artificial Sequence
  Synthetic
gccaagcatttaggtgacactatagacgtcatctgcagagagagcgtttcagagctatgctggaaacagc

SEQ ID NO: 68228 - DNA, 70 bp, Artificial Sequence
  Synthetic
gccaagcatttaggtgacactatagtgtaatcacacatcatcagcgtttcagagctatgctggaaacagc

SEQ ID NO: 68229 - DNA, 70 bp, Artificial Sequence
  Synthetic
gccaagcatttaggtgacactatagtcccagccgacgacgtctgagtttcagagctatgctggaaacagc

SEQ ID NO: 68230 - DNA, 70 bp, Artificial Sequence
  Synthetic
gccaagcatttaggtgacactatagtggcagccagtccggctaaggtttcagagctatgctggaaacagc

SEQ ID NO: 68231 - DNA, 70 bp, Artificial Sequence
  Synthetic
gccaagcatttaggtgacactatagtttattctgcacttttctgggtttcagagctatgctggaaacagc

SEQ ID NO: 68232 - DNA, 70 bp, Artificial Sequence
  Synthetic
gccaagcatttaggtgacactatagatagaagagacagagggattgtttcagagctatgctggaaacagc

SEQ ID NO: 68233 - DNA, 70 bp, Artificial Sequence
  Synthetic
gccaagcatttaggtgacactatagggagaccgagggctttggacgtttcagagctatgctggaaacagc

SEQ ID NO: 68234 - DNA, 70 bp, Artificial Sequence
  Synthetic
gccaagcatttaggtgacactatagtctcagttgatgacctacccgtttcagagctatgctggaaacagc

SEQ ID NO: 68235 - DNA, 70 bp, Artificial Sequence
  Synthetic
gccaagcatttaggtgacactatagcaatggtagtgattacagccgtttcagagctatgctggaaacagc

SEQ ID NO: 68236 - DNA, 70 bp, Artificial Sequence
  Synthetic
gccaagcatttaggtgacactatagggacgggtcagtcttccttcgtttcagagctatgctggaaacagc

SEQ ID NO: 68237 - DNA, 70 bp, Artificial Sequence
  Synthetic
gccaagcatttaggtgacactatagcggtggttagcttcatcaaagtttcagagctatgctggaaacagc

SEQ ID NO: 68238 - DNA, 70 bp, Artificial Sequence
  Synthetic
gccaagcatttaggtgacactatagcactgtaaaatgccagaagcgtttcagagctatgctggaaacagc

SEQ ID NO: 68239 - DNA, 70 bp, Artificial Sequence
  Synthetic
gccaagcatttaggtgacactatagggatttgggttccggcgtcagtttcagagctatgctggaaacagc

SEQ ID NO: 68240 - DNA, 70 bp, Artificial Sequence
  Synthetic
gccaagcatttaggtgacactatagaagggaaatcacaggtttaagtttcagagctatgctggaaacagc

SEQ ID NO: 68241 - DNA, 70 bp, Artificial Sequence
  Synthetic
gccaagcatttaggtgacactatagattttggcagaatcttccccgtttcagagctatgctggaaacagc

SEQ ID NO: 68242 - DNA, 70 bp, Artificial Sequence
  Synthetic
gccaagcatttaggtgacactataggttgtcttcgtttaaagctggtttcagagctatgctggaaacagc

SEQ ID NO: 68243 - DNA, 70 bp, Artificial Sequence
  Synthetic
gccaagcatttaggtgacactatagccccagctgattagtgtctagtttcagagctatgctggaaacagc

SEQ ID NO: 68244 - DNA, 70 bp, Artificial Sequence
  Synthetic
gccaagcatttaggtgacactatagttcattaatggcttccagctgtttcagagctatgctggaaacagc

SEQ ID NO: 68245 - DNA, 70 bp, Artificial Sequence
  Synthetic
gccaagcatttaggtgacactatagaatacagctgtgactctgacgtttcagagctatgctggaaacagc

SEQ ID NO: 68246 - DNA, 70 bp, Artificial Sequence
  Synthetic
gccaagcatttaggtgacactatagccagagactactagccagtcgtttcagagctatgctggaaacagc

SEQ ID NO: 68247 - DNA, 70 bp, Artificial Sequence
  Synthetic
gccaagcatttaggtgacactataggggcgcctccttctactgaggtttcagagctatgctggaaacagc

SEQ ID NO: 68248 - DNA, 70 bp, Artificial Sequence
  Synthetic
gccaagcatttaggtgacactatagctgcaaaccctggtctgtgagtttcagagctatgctggaaacagc

SEQ ID NO: 68249 - DNA, 70 bp, Artificial Sequence
  Synthetic
gccaagcatttaggtgacactataggtggtggtggtgacactgctgtttcagagctatgctggaaacagc

SEQ ID NO: 68250 - DNA, 70 bp, Artificial Sequence
  Synthetic
gccaagcatttaggtgacactatagagtaatgactgtgtagcacagtttcagagctatgctggaaacagc

SEQ ID NO: 68251 - DNA, 70 bp, Artificial Sequence
  Synthetic
gccaagcatttaggtgacactatagctgtcacagcagctttctgggtttcagagctatgctggaaacagc

SEQ ID NO: 68252 - DNA, 70 bp, Artificial Sequence
  Synthetic
gccaagcatttaggtgacactatagtgggaggcggtgggcctcacgtttcagagctatgctggaaacagc

SEQ ID NO: 68253 - DNA, 70 bp, Artificial Sequence
  Synthetic
gccaagcatttaggtgacactatagaattctgcttgtctgccactgtttcagagctatgctggaaacagc

SEQ ID NO: 68254 - DNA, 70 bp, Artificial Sequence
  Synthetic
gccaagcatttaggtgacactataggcagtcagaacaactcacgggtttcagagctatgctggaaacagc

SEQ ID NO: 68255 - DNA, 70 bp, Artificial Sequence
  Synthetic
gccaagcatttaggtgacactatagagatctctgctctgcttaatgtttcagagctatgctggaaacagc

SEQ ID NO: 68256 - DNA, 70 bp, Artificial Sequence
  Synthetic
gccaagcatttaggtgacactatagtgtcactcctgcaatagggtgtttcagagctatgctggaaacagc

SEQ ID NO: 68257 - DNA, 70 bp, Artificial Sequence
  Synthetic
gccaagcatttaggtgacactatagtgcccttattcaggagcggtgtttcagagctatgctggaaacagc

SEQ ID NO: 68258 - DNA, 70 bp, Artificial Sequence
  Synthetic
gccaagcatttaggtgacactatagtgtggtcagatgaaaaaactgtttcagagctatgctggaaacagc

SEQ ID NO: 68259 - DNA, 70 bp, Artificial Sequence
  Synthetic
gccaagcatttaggtgacactatagcatactgtagcaactcataggtttcagagctatgctggaaacagc

SEQ ID NO: 68260 - DNA, 70 bp, Artificial Sequence
  Synthetic
gccaagcatttaggtgacactatagggagtatgagaccacagtgtgtttcagagctatgctggaaacagc

SEQ ID NO: 68261 - DNA, 70 bp, Artificial Sequence
  Synthetic
gccaagcatttaggtgacactatagtgcttcgccagtgaagggatgtttcagagctatgctggaaacagc

SEQ ID NO: 68262 - DNA, 70 bp, Artificial Sequence
  Synthetic
gccaagcatttaggtgacactatagtttgtttctgcacttctgttgtttcagagctatgctggaaacagc

SEQ ID NO: 68263 - DNA, 70 bp, Artificial Sequence
  Synthetic
gccaagcatttaggtgacactatagcaccctttgagactgaagcagtttcagagctatgctggaaacagc

SEQ ID NO: 68264 - DNA, 70 bp, Artificial Sequence
  Synthetic
gccaagcatttaggtgacactatagtccagcatggtgggtaagtagtttcagagctatgctggaaacagc

SEQ ID NO: 68265 - DNA, 70 bp, Artificial Sequence
  Synthetic
gccaagcatttaggtgacactatagcgtaagacttgtactatgtggtttcagagctatgctggaaacagc

SEQ ID NO: 68266 - DNA, 70 bp, Artificial Sequence
  Synthetic
gccaagcatttaggtgacactatagtcagctcacagctgctcaaagtttcagagctatgctggaaacagc

SEQ ID NO: 68267 - DNA, 70 bp, Artificial Sequence
  Synthetic
gccaagcatttaggtgacactataggccgccaggaagctctcgaggtttcagagctatgctggaaacagc

SEQ ID NO: 68268 - DNA, 70 bp, Artificial Sequence
  Synthetic
gccaagcatttaggtgacactatagttacaaaaacaaaaccgggggtttcagagctatgctggaaacagc

SEQ ID NO: 68269 - DNA, 70 bp, Artificial Sequence
  Synthetic
gccaagcatttaggtgacactatagtccttggctggagtgtctaggtttcagagctatgctggaaacagc

SEQ ID NO: 68270 - DNA, 70 bp, Artificial Sequence
  Synthetic
gccaagcatttaggtgacactataggcagtgaaggtcaagaagccgtttcagagctatgctggaaacagc

SEQ ID NO: 68271 - DNA, 70 bp, Artificial Sequence
  Synthetic
gccaagcatttaggtgacactatagtaccagcttcccgagtagctgtttcagagctatgctggaaacagc

SEQ ID NO: 68272 - DNA, 70 bp, Artificial Sequence
  Synthetic
gccaagcatttaggtgacactatagatttcttctggaatctcatggtttcagagctatgctggaaacagc

SEQ ID NO: 68273 - DNA, 70 bp, Artificial Sequence
  Synthetic
gccaagcatttaggtgacactataggctggatcggaagcagaagagtttcagagctatgctggaaacagc

SEQ ID NO: 68274 - DNA, 70 bp, Artificial Sequence
  Synthetic
gccaagcatttaggtgacactatagcttgattcagggttcaaagagtttcagagctatgctggaaacagc

SEQ ID NO: 68275 - DNA, 70 bp, Artificial Sequence
  Synthetic
gccaagcatttaggtgacactatagccctggcactgtgaagctctgtttcagagctatgctggaaacagc

SEQ ID NO: 68276 - DNA, 70 bp, Artificial Sequence
  Synthetic
gccaagcatttaggtgacactatagattgctattcacgccataaggtttcagagctatgctggaaacagc

SEQ ID NO: 68277 - DNA, 70 bp, Artificial Sequence
  Synthetic
gccaagcatttaggtgacactatagttccagagagcaaagccctggtttcagagctatgctggaaacagc

SEQ ID NO: 68278 - DNA, 70 bp, Artificial Sequence
  Synthetic
gccaagcatttaggtgacactatagatccaaggctcgtgacactagtttcagagctatgctggaaacagc

SEQ ID NO: 68279 - DNA, 70 bp, Artificial Sequence
  Synthetic
gccaagcatttaggtgacactataggccctttacagcactcacaagtttcagagctatgctggaaacagc

SEQ ID NO: 68280 - DNA, 70 bp, Artificial Sequence
  Synthetic
gccaagcatttaggtgacactatagtagcacatacttcaggcttggtttcagagctatgctggaaacagc

SEQ ID NO: 68281 - DNA, 70 bp, Artificial Sequence
  Synthetic
gccaagcatttaggtgacactatagggcagcaactggtgaagcacgtttcagagctatgctggaaacagc

SEQ ID NO: 68282 - DNA, 70 bp, Artificial Sequence
  Synthetic
gccaagcatttaggtgacactataggggacccagtcccactgacagtttcagagctatgctggaaacagc

SEQ ID NO: 68283 - DNA, 70 bp, Artificial Sequence
  Synthetic
gccaagcatttaggtgacactatagatctcatcaaagaggtcttcgtttcagagctatgctggaaacagc

SEQ ID NO: 68284 - DNA, 70 bp, Artificial Sequence
  Synthetic
gccaagcatttaggtgacactatagctgattttgcttccatcacagtttcagagctatgctggaaacagc

SEQ ID NO: 68285 - DNA, 70 bp, Artificial Sequence
  Synthetic
gccaagcatttaggtgacactatagatttgaagaaggtggtgatggtttcagagctatgctggaaacagc

SEQ ID NO: 68286 - DNA, 70 bp, Artificial Sequence
  Synthetic
gccaagcatttaggtgacactataggcgcggcctctggtcagtccgtttcagagctatgctggaaacagc

SEQ ID NO: 68287 - DNA, 70 bp, Artificial Sequence
  Synthetic
gccaagcatttaggtgacactatagaagagccaaatttactcagagtttcagagctatgctggaaacagc

SEQ ID NO: 68288 - DNA, 70 bp, Artificial Sequence
  Synthetic
gccaagcatttaggtgacactatagatattacatgacgaagatgggtttcagagctatgctggaaacagc

SEQ ID NO: 68289 - DNA, 70 bp, Artificial Sequence
  Synthetic
gccaagcatttaggtgacactatagcaccctcaggaagatacaatgtttcagagctatgctggaaacagc

SEQ ID NO: 68290 - DNA, 70 bp, Artificial Sequence
  Synthetic
gccaagcatttaggtgacactatagcccacagccagtgactcacagtttcagagctatgctggaaacagc

SEQ ID NO: 68291 - DNA, 70 bp, Artificial Sequence
  Synthetic
gccaagcatttaggtgacactatagccagtggacagaacggcggcgtttcagagctatgctggaaacagc

SEQ ID NO: 68292 - DNA, 70 bp, Artificial Sequence
  Synthetic
gccaagcatttaggtgacactatagcactcccatcccggaggactgtttcagagctatgctggaaacagc

SEQ ID NO: 68293 - DNA, 70 bp, Artificial Sequence
  Synthetic
gccaagcatttaggtgacactatagaggattgctttaacagtactgtttcagagctatgctggaaacagc

SEQ ID NO: 68294 - DNA, 70 bp, Artificial Sequence
  Synthetic
gccaagcatttaggtgacactatagcgggggcctccggagtgaacgtttcagagctatgctggaaacagc

SEQ ID NO: 68295 - DNA, 70 bp, Artificial Sequence
  Synthetic
gccaagcatttaggtgacactatagtactgattgtgctttacatggtttcagagctatgctggaaacagc

SEQ ID NO: 68296 - DNA, 70 bp, Artificial Sequence
  Synthetic
gccaagcatttaggtgacactataggtgcccagtgctacctgagcgtttcagagctatgctggaaacagc

SEQ ID NO: 68297 - DNA, 70 bp, Artificial Sequence
  Synthetic
gccaagcatttaggtgacactataggacgggcgactcaggtagcagtttcagagctatgctggaaacagc

SEQ ID NO: 68298 - DNA, 70 bp, Artificial Sequence
  Synthetic
gccaagcatttaggtgacactataggccagtttagttaaacagctgtttcagagctatgctggaaacagc

SEQ ID NO: 68299 - DNA, 70 bp, Artificial Sequence
  Synthetic
gccaagcatttaggtgacactatagtgaaaaatgtgtttcggagtgtttcagagctatgctggaaacagc

SEQ ID NO: 68300 - DNA, 70 bp, Artificial Sequence
  Synthetic
gccaagcatttaggtgacactatagggagaagcctcatcattgaagtttcagagctatgctggaaacagc

SEQ ID NO: 68301 - DNA, 70 bp, Artificial Sequence
  Synthetic
gccaagcatttaggtgacactatagcctagtttaaaagaggcttggtttcagagctatgctggaaacagc

SEQ ID NO: 68302 - DNA, 70 bp, Artificial Sequence
  Synthetic
gccaagcatttaggtgacactataggctttctttatctagcttgggtttcagagctatgctggaaacagc

SEQ ID NO: 68303 - DNA, 70 bp, Artificial Sequence
  Synthetic
gccaagcatttaggtgacactatagcctgtaaatcgctgaaaggggtttcagagctatgctggaaacagc

SEQ ID NO: 68304 - DNA, 70 bp, Artificial Sequence
  Synthetic
gccaagcatttaggtgacactatagtctcaggatttgttacttgtgtttcagagctatgctggaaacagc

SEQ ID NO: 68305 - DNA, 70 bp, Artificial Sequence
  Synthetic
gccaagcatttaggtgacactataggcctcttcggagggagctgagtttcagagctatgctggaaacagc

SEQ ID NO: 68306 - DNA, 70 bp, Artificial Sequence
  Synthetic
gccaagcatttaggtgacactatagtgacgtcctgactgtaagcggtttcagagctatgctggaaacagc

SEQ ID NO: 68307 - DNA, 70 bp, Artificial Sequence
  Synthetic
gccaagcatttaggtgacactatagtcccgaggctgagcagggcggtttcagagctatgctggaaacagc

SEQ ID NO: 68308 - DNA, 70 bp, Artificial Sequence
  Synthetic
gccaagcatttaggtgacactatagagttgagttggaatcactccgtttcagagctatgctggaaacagc

SEQ ID NO: 68309 - DNA, 70 bp, Artificial Sequence
  Synthetic
gccaagcatttaggtgacactataggttactcagcactgctctgcgtttcagagctatgctggaaacagc

SEQ ID NO: 68310 - DNA, 70 bp, Artificial Sequence
  Synthetic
gccaagcatttaggtgacactatagtgtctgtagggggtcagagtgtttcagagctatgctggaaacagc

SEQ ID NO: 68311 - DNA, 70 bp, Artificial Sequence
  Synthetic
gccaagcatttaggtgacactataggggcacctcactccgctcacgtttcagagctatgctggaaacagc

SEQ ID NO: 68312 - DNA, 70 bp, Artificial Sequence
  Synthetic
gccaagcatttaggtgacactatagtactgtggctttcccagagagtttcagagctatgctggaaacagc

SEQ ID NO: 68313 - DNA, 70 bp, Artificial Sequence
  Synthetic
gccaagcatttaggtgacactatagctttgagattgcagagcttagtttcagagctatgctggaaacagc

SEQ ID NO: 68314 - DNA, 70 bp, Artificial Sequence
  Synthetic
gccaagcatttaggtgacactatagacagagccacagtaccagccgtttcagagctatgctggaaacagc

SEQ ID NO: 68315 - DNA, 70 bp, Artificial Sequence
  Synthetic
gccaagcatttaggtgacactatagatctggggccagggggtcacgtttcagagctatgctggaaacagc

SEQ ID NO: 68316 - DNA, 70 bp, Artificial Sequence
  Synthetic
gccaagcatttaggtgacactatagagatcttcagccgcagcgtcgtttcagagctatgctggaaacagc

SEQ ID NO: 68317 - DNA, 70 bp, Artificial Sequence
  Synthetic
gccaagcatttaggtgacactataggcgggcgcgctcaccgcaccgtttcagagctatgctggaaacagc

SEQ ID NO: 68318 - DNA, 70 bp, Artificial Sequence
  Synthetic
gccaagcatttaggtgacactataggcagccaagtccagctaatggtttcagagctatgctggaaacagc

SEQ ID NO: 68319 - DNA, 70 bp, Artificial Sequence
  Synthetic
gccaagcatttaggtgacactatagtccctggccccctcctaggagtttcagagctatgctggaaacagc

SEQ ID NO: 68320 - DNA, 70 bp, Artificial Sequence
  Synthetic
gccaagcatttaggtgacactatagggtggggtcagtgtgactgcgtttcagagctatgctggaaacagc

SEQ ID NO: 68321 - DNA, 70 bp, Artificial Sequence
  Synthetic
gccaagcatttaggtgacactatagagtgctgcttcattgttagtgtttcagagctatgctggaaacagc

SEQ ID NO: 68322 - DNA, 70 bp, Artificial Sequence
  Synthetic
gccaagcatttaggtgacactatagtatccttgcgctttgttatagtttcagagctatgctggaaacagc

SEQ ID NO: 68323 - DNA, 70 bp, Artificial Sequence
  Synthetic
gccaagcatttaggtgacactatagttcccattcctgatttactggtttcagagctatgctggaaacagc

SEQ ID NO: 68324 - DNA, 70 bp, Artificial Sequence
  Synthetic
gccaagcatttaggtgacactatagtacccttgtgccatactttagtttcagagctatgctggaaacagc

SEQ ID NO: 68325 - DNA, 70 bp, Artificial Sequence
  Synthetic
gccaagcatttaggtgacactatagcacgggcaccgactgcgtcggtttcagagctatgctggaaacagc

SEQ ID NO: 68326 - DNA, 70 bp, Artificial Sequence
  Synthetic
gccaagcatttaggtgacactatagtggcaggctgcatcacatgagtttcagagctatgctggaaacagc

SEQ ID NO: 68327 - DNA, 70 bp, Artificial Sequence
  Synthetic
gccaagcatttaggtgacactataggattgagggctttttcagccgtttcagagctatgctggaaacagc

SEQ ID NO: 68328 - DNA, 70 bp, Artificial Sequence
  Synthetic
gccaagcatttaggtgacactatagtgttcttgaggggaaaaagtgtttcagagctatgctggaaacagc

SEQ ID NO: 68329 - DNA, 70 bp, Artificial Sequence
  Synthetic
gccaagcatttaggtgacactatagaggtcacacttctccaaagtgtttcagagctatgctggaaacagc

SEQ ID NO: 68330 - DNA, 70 bp, Artificial Sequence
  Synthetic
gccaagcatttaggtgacactatagaggaatgaagactcactcaagtttcagagctatgctggaaacagc

SEQ ID NO: 68331 - DNA, 70 bp, Artificial Sequence
  Synthetic
gccaagcatttaggtgacactatagggacaatggctgggactgatgtttcagagctatgctggaaacagc

SEQ ID NO: 68332 - DNA, 70 bp, Artificial Sequence
  Synthetic
gccaagcatttaggtgacactatagcatgatcaaagacaacggctgtttcagagctatgctggaaacagc

SEQ ID NO: 68333 - DNA, 70 bp, Artificial Sequence
  Synthetic
gccaagcatttaggtgacactatagggacaacggctgggactgaggtttcagagctatgctggaaacagc

SEQ ID NO: 68334 - DNA, 70 bp, Artificial Sequence
  Synthetic
gccaagcatttaggtgacactatagtcgagagagtgagggctttggtttcagagctatgctggaaacagc

SEQ ID NO: 68335 - DNA, 70 bp, Artificial Sequence
  Synthetic
gccaagcatttaggtgacactatagcctgcttcccagagtttcacgtttcagagctatgctggaaacagc

SEQ ID NO: 68336 - DNA, 70 bp, Artificial Sequence
  Synthetic
gccaagcatttaggtgacactataggacagagaccgaggggagaggtttcagagctatgctggaaacagc

SEQ ID NO: 68337 - DNA, 70 bp, Artificial Sequence
  Synthetic
gccaagcatttaggtgacactatagagttgtgtttttttctcccagtttcagagctatgctggaaacagc

SEQ ID NO: 68338 - DNA, 70 bp, Artificial Sequence
  Synthetic
gccaagcatttaggtgacactatagagagtcgaaacaaacaatgagtttcagagctatgctggaaacagc

SEQ ID NO: 68339 - DNA, 70 bp, Artificial Sequence
  Synthetic
gccaagcatttaggtgacactatagtcaaggtcgtgggaaataaagtttcagagctatgctggaaacagc

SEQ ID NO: 68340 - DNA, 70 bp, Artificial Sequence
  Synthetic
gccaagcatttaggtgacactatagagaggaggaagccatgcgtagtttcagagctatgctggaaacagc

SEQ ID NO: 68341 - DNA, 70 bp, Artificial Sequence
  Synthetic
gccaagcatttaggtgacactataggacgaaggagacgctggggagtttcagagctatgctggaaacagc

SEQ ID NO: 68342 - DNA, 70 bp, Artificial Sequence
  Synthetic
gccaagcatttaggtgacactatagtaaagaagcgctgcaggacggtttcagagctatgctggaaacagc

SEQ ID NO: 68343 - DNA, 70 bp, Artificial Sequence
  Synthetic
gccaagcatttaggtgacactatagggcggcgaaggcaacaattagtttcagagctatgctggaaacagc

SEQ ID NO: 68344 - DNA, 70 bp, Artificial Sequence
  Synthetic
gccaagcatttaggtgacactatagcaggatgaagaagcaggagagtttcagagctatgctggaaacagc

SEQ ID NO: 68345 - DNA, 70 bp, Artificial Sequence
  Synthetic
gccaagcatttaggtgacactatagagaatgtgatgcggcagaaggtttcagagctatgctggaaacagc

SEQ ID NO: 68346 - DNA, 70 bp, Artificial Sequence
  Synthetic
gccaagcatttaggtgacactatagagaaggaggggaaaattaacgtttcagagctatgctggaaacagc

SEQ ID NO: 68347 - DNA, 70 bp, Artificial Sequence
  Synthetic
gccaagcatttaggtgacactataggtcttctctcttcttttcacgtttcagagctatgctggaaacagc

SEQ ID NO: 68348 - DNA, 70 bp, Artificial Sequence
  Synthetic
gccaagcatttaggtgacactataggatgctacagaggaaatcaggtttcagagctatgctggaaacagc

SEQ ID NO: 68349 - DNA, 70 bp, Artificial Sequence
  Synthetic
gccaagcatttaggtgacactataggctgatggtgctagagaggtgtttcagagctatgctggaaacagc

SEQ ID NO: 68350 - DNA, 70 bp, Artificial Sequence
  Synthetic
gccaagcatttaggtgacactatagaccaaaaacaacccgtgaaagtttcagagctatgctggaaacagc

SEQ ID NO: 68351 - DNA, 70 bp, Artificial Sequence
  Synthetic
gccaagcatttaggtgacactatagaggcggcctagactgtaaaggtttcagagctatgctggaaacagc

SEQ ID NO: 68352 - DNA, 70 bp, Artificial Sequence
  Synthetic
gccaagcatttaggtgacactatagagcttactgttgacagagtggtttcagagctatgctggaaacagc

SEQ ID NO: 68353 - DNA, 70 bp, Artificial Sequence
  Synthetic
gccaagcatttaggtgacactatagtcaaaactgagcaacttaacgtttcagagctatgctggaaacagc

SEQ ID NO: 68354 - DNA, 70 bp, Artificial Sequence
  Synthetic
gccaagcatttaggtgacactatagggcagcgggagctcaggcacgtttcagagctatgctggaaacagc

SEQ ID NO: 68355 - DNA, 70 bp, Artificial Sequence
  Synthetic
gccaagcatttaggtgacactataggaagctgaaagtgctgtcacgtttcagagctatgctggaaacagc

SEQ ID NO: 68356 - DNA, 70 bp, Artificial Sequence
  Synthetic
gccaagcatttaggtgacactatagaaagctgtaaatattgccacgtttcagagctatgctggaaacagc

SEQ ID NO: 68357 - DNA, 70 bp, Artificial Sequence
  Synthetic
gccaagcatttaggtgacactatagcttctggcttctgtttattggtttcagagctatgctggaaacagc

SEQ ID NO: 68358 - DNA, 70 bp, Artificial Sequence
  Synthetic
gccaagcatttaggtgacactatagaacatgtcatcacactaccggtttcagagctatgctggaaacagc

SEQ ID NO: 68359 - DNA, 70 bp, Artificial Sequence
  Synthetic
gccaagcatttaggtgacactataggacagcagcttcctgtagcggtttcagagctatgctggaaacagc

SEQ ID NO: 68360 - DNA, 70 bp, Artificial Sequence
  Synthetic
gccaagcatttaggtgacactatagtggaagggatgtactgctgcgtttcagagctatgctggaaacagc

SEQ ID NO: 68361 - DNA, 70 bp, Artificial Sequence
  Synthetic
gccaagcatttaggtgacactatagggaagtggccacacccctacgtttcagagctatgctggaaacagc

SEQ ID NO: 68362 - DNA, 70 bp, Artificial Sequence
  Synthetic
gccaagcatttaggtgacactatagtggccaatccaggctcatgagtttcagagctatgctggaaacagc

SEQ ID NO: 68363 - DNA, 70 bp, Artificial Sequence
  Synthetic
gccaagcatttaggtgacactatagctaagtcggattcgcatatggtttcagagctatgctggaaacagc

SEQ ID NO: 68364 - DNA, 70 bp, Artificial Sequence
  Synthetic
gccaagcatttaggtgacactatagtgaacaacttcattctgctcgtttcagagctatgctggaaacagc

SEQ ID NO: 68365 - DNA, 70 bp, Artificial Sequence
  Synthetic
gccaagcatttaggtgacactatagggcaaagatgctttcagagagtttcagagctatgctggaaacagc

SEQ ID NO: 68366 - DNA, 70 bp, Artificial Sequence
  Synthetic
gccaagcatttaggtgacactatagtcaatgatgtccgagaaacggtttcagagctatgctggaaacagc

SEQ ID NO: 68367 - DNA, 70 bp, Artificial Sequence
  Synthetic
gccaagcatttaggtgacactatagttgatgacaatgctaccctcgtttcagagctatgctggaaacagc

SEQ ID NO: 68368 - DNA, 70 bp, Artificial Sequence
  Synthetic
gccaagcatttaggtgacactatagaggggagctggtggggaggtgtttcagagctatgctggaaacagc

SEQ ID NO: 68369 - DNA, 70 bp, Artificial Sequence
  Synthetic
gccaagcatttaggtgacactatagctgggtgggggcaaagggtagtttcagagctatgctggaaacagc

SEQ ID NO: 68370 - DNA, 70 bp, Artificial Sequence
  Synthetic
gccaagcatttaggtgacactatagcagatctctcacttctccacgtttcagagctatgctggaaacagc

SEQ ID NO: 68371 - DNA, 70 bp, Artificial Sequence
  Synthetic
gccaagcatttaggtgacactatagtcaggttcttttcaaatgctgtttcagagctatgctggaaacagc

SEQ ID NO: 68372 - DNA, 70 bp, Artificial Sequence
  Synthetic
gccaagcatttaggtgacactatagccctctcgatgggatgaatcgtttcagagctatgctggaaacagc

SEQ ID NO: 68373 - DNA, 70 bp, Artificial Sequence
  Synthetic
gccaagcatttaggtgacactataggaggtagcacatatttcagggtttcagagctatgctggaaacagc

SEQ ID NO: 68374 - DNA, 70 bp, Artificial Sequence
  Synthetic
gccaagcatttaggtgacactatagctccacgcctgcgcggctaggtttcagagctatgctggaaacagc

SEQ ID NO: 68375 - DNA, 70 bp, Artificial Sequence
  Synthetic
gccaagcatttaggtgacactatagagacgatagcctgtagctaggtttcagagctatgctggaaacagc

SEQ ID NO: 68376 - DNA, 70 bp, Artificial Sequence
  Synthetic
gccaagcatttaggtgacactatagctacctgtgctatgtgtgaagtttcagagctatgctggaaacagc

SEQ ID NO: 68377 - DNA, 70 bp, Artificial Sequence
  Synthetic
gccaagcatttaggtgacactatagcccccgcctgccgagtgagcgtttcagagctatgctggaaacagc

SEQ ID NO: 68378 - DNA, 70 bp, Artificial Sequence
  Synthetic
gccaagcatttaggtgacactatagaagatagctctcaagaacttgtttcagagctatgctggaaacagc

SEQ ID NO: 68379 - DNA, 70 bp, Artificial Sequence
  Synthetic
gccaagcatttaggtgacactatagtgacattcagtctagtaagagtttcagagctatgctggaaacagc

SEQ ID NO: 68380 - DNA, 70 bp, Artificial Sequence
  Synthetic
gccaagcatttaggtgacactatagatgaggatgcatgtgtctgagtttcagagctatgctggaaacagc

SEQ ID NO: 68381 - DNA, 70 bp, Artificial Sequence
  Synthetic
gccaagcatttaggtgacactatagtcaagactgcatttagtcttgtttcagagctatgctggaaacagc

SEQ ID NO: 68382 - DNA, 70 bp, Artificial Sequence
  Synthetic
gccaagcatttaggtgacactatagggtggaggagcaaactgaaggtttcagagctatgctggaaacagc

SEQ ID NO: 68383 - DNA, 70 bp, Artificial Sequence
  Synthetic
gccaagcatttaggtgacactatagttacaggtcagctctgctccgtttcagagctatgctggaaacagc

SEQ ID NO: 68384 - DNA, 70 bp, Artificial Sequence
  Synthetic
gccaagcatttaggtgacactatagttgcagtgtgttgcagaattgtttcagagctatgctggaaacagc

SEQ ID NO: 68385 - DNA, 70 bp, Artificial Sequence
  Synthetic
gccaagcatttaggtgacactatagagagaagctgctactcaactgtttcagagctatgctggaaacagc

SEQ ID NO: 68386 - DNA, 70 bp, Artificial Sequence
  Synthetic
gccaagcatttaggtgacactataggacggcctgagccagggctagtttcagagctatgctggaaacagc

SEQ ID NO: 68387 - DNA, 70 bp, Artificial Sequence
  Synthetic
gccaagcatttaggtgacactatagagtacttgtgtgaattgagtgtttcagagctatgctggaaacagc

SEQ ID NO: 68388 - DNA, 70 bp, Artificial Sequence
  Synthetic
gccaagcatttaggtgacactataggccccaaaaactaacatctagtttcagagctatgctggaaacagc

SEQ ID NO: 68389 - DNA, 70 bp, Artificial Sequence
  Synthetic
gccaagcatttaggtgacactatagtcttcctccaccacctgacggtttcagagctatgctggaaacagc

SEQ ID NO: 68390 - DNA, 70 bp, Artificial Sequence
  Synthetic
gccaagcatttaggtgacactatagaaaggagtttagtaagactcgtttcagagctatgctggaaacagc

SEQ ID NO: 68391 - DNA, 70 bp, Artificial Sequence
  Synthetic
gccaagcatttaggtgacactatagtctgatgctcccgattaagagtttcagagctatgctggaaacagc

SEQ ID NO: 68392 - DNA, 70 bp, Artificial Sequence
  Synthetic
gccaagcatttaggtgacactatagagaactgctttggtggttgggtttcagagctatgctggaaacagc

SEQ ID NO: 68393 - DNA, 70 bp, Artificial Sequence
  Synthetic
gccaagcatttaggtgacactatagcaacaagcagtgaagttgacgtttcagagctatgctggaaacagc

SEQ ID NO: 68394 - DNA, 70 bp, Artificial Sequence
  Synthetic
gccaagcatttaggtgacactatagtccccctggatgtttcagtcgtttcagagctatgctggaaacagc

SEQ ID NO: 68395 - DNA, 70 bp, Artificial Sequence
  Synthetic
gccaagcatttaggtgacactatagttctaattcttgccactcaagtttcagagctatgctggaaacagc

SEQ ID NO: 68396 - DNA, 70 bp, Artificial Sequence
  Synthetic
gccaagcatttaggtgacactatagaagaacccggacagttgactgtttcagagctatgctggaaacagc

SEQ ID NO: 68397 - DNA, 70 bp, Artificial Sequence
  Synthetic
gccaagcatttaggtgacactataggaacccagaagggcgatgtggtttcagagctatgctggaaacagc

SEQ ID NO: 68398 - DNA, 70 bp, Artificial Sequence
  Synthetic
gccaagcatttaggtgacactatagcggatgaaaggctgctcattgtttcagagctatgctggaaacagc

SEQ ID NO: 68399 - DNA, 70 bp, Artificial Sequence
  Synthetic
gccaagcatttaggtgacactatagctgggccttgatagcactacgtttcagagctatgctggaaacagc

SEQ ID NO: 68400 - DNA, 70 bp, Artificial Sequence
  Synthetic
gccaagcatttaggtgacactatagcagggatgcatcacaccagagtttcagagctatgctggaaacagc

SEQ ID NO: 68401 - DNA, 70 bp, Artificial Sequence
  Synthetic
gccaagcatttaggtgacactatagggctgagcagaatacaactggtttcagagctatgctggaaacagc

SEQ ID NO: 68402 - DNA, 70 bp, Artificial Sequence
  Synthetic
gccaagcatttaggtgacactatagaggaaatcacttcatgctttgtttcagagctatgctggaaacagc

SEQ ID NO: 68403 - DNA, 70 bp, Artificial Sequence
  Synthetic
gccaagcatttaggtgacactatagcaatcatggttccttgccttgtttcagagctatgctggaaacagc

SEQ ID NO: 68404 - DNA, 70 bp, Artificial Sequence
  Synthetic
gccaagcatttaggtgacactataggtggatgaaatgaccaggaagtttcagagctatgctggaaacagc

SEQ ID NO: 68405 - DNA, 70 bp, Artificial Sequence
  Synthetic
gccaagcatttaggtgacactatagcggcgcaccctgcgccctgagtttcagagctatgctggaaacagc

SEQ ID NO: 68406 - DNA, 70 bp, Artificial Sequence
  Synthetic
gccaagcatttaggtgacactatagggacttcgcctggctctcctgtttcagagctatgctggaaacagc

SEQ ID NO: 68407 - DNA, 70 bp, Artificial Sequence
  Synthetic
gccaagcatttaggtgacactataggcagctcggcagctagttgtgtttcagagctatgctggaaacagc

SEQ ID NO: 68408 - DNA, 70 bp, Artificial Sequence
  Synthetic
gccaagcatttaggtgacactataggggctatgtgtcacagtcctgtttcagagctatgctggaaacagc

SEQ ID NO: 68409 - DNA, 70 bp, Artificial Sequence
  Synthetic
gccaagcatttaggtgacactatagggagaagcgcggtacatcacgtttcagagctatgctggaaacagc

SEQ ID NO: 68410 - DNA, 70 bp, Artificial Sequence
  Synthetic
gccaagcatttaggtgacactatagaaacagctagagcaaagtgcgtttcagagctatgctggaaacagc

SEQ ID NO: 68411 - DNA, 70 bp, Artificial Sequence
  Synthetic
gccaagcatttaggtgacactatagtatctaggcctgatctcaaagtttcagagctatgctggaaacagc

SEQ ID NO: 68412 - DNA, 70 bp, Artificial Sequence
  Synthetic
gccaagcatttaggtgacactatagttttggtttttaggcgagtcgtttcagagctatgctggaaacagc

SEQ ID NO: 68413 - DNA, 70 bp, Artificial Sequence
  Synthetic
gccaagcatttaggtgacactataggccatggagtcctcttaaaggtttcagagctatgctggaaacagc

SEQ ID NO: 68414 - DNA, 70 bp, Artificial Sequence
  Synthetic
gccaagcatttaggtgacactatagtccgaagccaacaactaggcgtttcagagctatgctggaaacagc

SEQ ID NO: 68415 - DNA, 70 bp, Artificial Sequence
  Synthetic
gccaagcatttaggtgacactatagacattacagctacctaatgtgtttcagagctatgctggaaacagc

SEQ ID NO: 68416 - DNA, 70 bp, Artificial Sequence
  Synthetic
gccaagcatttaggtgacactatagatcttcactcaagtgccatcgtttcagagctatgctggaaacagc

SEQ ID NO: 68417 - DNA, 70 bp, Artificial Sequence
  Synthetic
gccaagcatttaggtgacactatagattgctacgtaagtgtctctgtttcagagctatgctggaaacagc

SEQ ID NO: 68418 - DNA, 70 bp, Artificial Sequence
  Synthetic
gccaagcatttaggtgacactatagggtctataatgaagagaaccgtttcagagctatgctggaaacagc

SEQ ID NO: 68419 - DNA, 70 bp, Artificial Sequence
  Synthetic
gccaagcatttaggtgacactatagttcattgtccaagcaccctcgtttcagagctatgctggaaacagc

SEQ ID NO: 68420 - DNA, 70 bp, Artificial Sequence
  Synthetic
gccaagcatttaggtgacactataggcagtcacttgtaagtccaggtttcagagctatgctggaaacagc

SEQ ID NO: 68421 - DNA, 70 bp, Artificial Sequence
  Synthetic
gccaagcatttaggtgacactataggccaaattttgctgtgaatggtttcagagctatgctggaaacagc

SEQ ID NO: 68422 - DNA, 70 bp, Artificial Sequence
  Synthetic
gccaagcatttaggtgacactatagtctggagcaaaactcagacagtttcagagctatgctggaaacagc

SEQ ID NO: 68423 - DNA, 70 bp, Artificial Sequence
  Synthetic
gccaagcatttaggtgacactatagaacctcctcagaagagcaacgtttcagagctatgctggaaacagc

SEQ ID NO: 68424 - DNA, 70 bp, Artificial Sequence
  Synthetic
gccaagcatttaggtgacactatagctccccaggagcagagttaagtttcagagctatgctggaaacagc

SEQ ID NO: 68425 - DNA, 70 bp, Artificial Sequence
  Synthetic
gccaagcatttaggtgacactatagtccattgaagagccacagctgtttcagagctatgctggaaacagc

SEQ ID NO: 68426 - DNA, 70 bp, Artificial Sequence
  Synthetic
gccaagcatttaggtgacactatagacggccatgccacactgatggtttcagagctatgctggaaacagc

SEQ ID NO: 68427 - DNA, 70 bp, Artificial Sequence
  Synthetic
gccaagcatttaggtgacactatagtttctgatagctcaagcagagtttcagagctatgctggaaacagc

SEQ ID NO: 68428 - DNA, 70 bp, Artificial Sequence
  Synthetic
gccaagcatttaggtgacactataggccacaggcagcttactcacgtttcagagctatgctggaaacagc

SEQ ID NO: 68429 - DNA, 70 bp, Artificial Sequence
  Synthetic
gccaagcatttaggtgacactatagccttgattgttgctaagcttgtttcagagctatgctggaaacagc

SEQ ID NO: 68430 - DNA, 70 bp, Artificial Sequence
  Synthetic
gccaagcatttaggtgacactatagtcatctttcaataacccagcgtttcagagctatgctggaaacagc

SEQ ID NO: 68431 - DNA, 70 bp, Artificial Sequence
  Synthetic
gccaagcatttaggtgacactatagcgcccctgggcaagccctaagtttcagagctatgctggaaacagc

SEQ ID NO: 68432 - DNA, 70 bp, Artificial Sequence
  Synthetic
gccaagcatttaggtgacactatagaagacacacacagttcctgtgtttcagagctatgctggaaacagc

SEQ ID NO: 68433 - DNA, 70 bp, Artificial Sequence
  Synthetic
gccaagcatttaggtgacactataggggatttctaaaaagttggcgtttcagagctatgctggaaacagc

SEQ ID NO: 68434 - DNA, 70 bp, Artificial Sequence
  Synthetic
gccaagcatttaggtgacactatagttgaggtcgaatccatttcagtttcagagctatgctggaaacagc

SEQ ID NO: 68435 - DNA, 70 bp, Artificial Sequence
  Synthetic
gccaagcatttaggtgacactatagtcttttcactggagaggattgtttcagagctatgctggaaacagc

SEQ ID NO: 68436 - DNA, 70 bp, Artificial Sequence
  Synthetic
gccaagcatttaggtgacactatagcaagatccccgggaaagcatgtttcagagctatgctggaaacagc

SEQ ID NO: 68437 - DNA, 70 bp, Artificial Sequence
  Synthetic
gccaagcatttaggtgacactatagcacatcaaaccacgtctgtggtttcagagctatgctggaaacagc

SEQ ID NO: 68438 - DNA, 70 bp, Artificial Sequence
  Synthetic
gccaagcatttaggtgacactatagcagctctggctggacactacgtttcagagctatgctggaaacagc

SEQ ID NO: 68439 - DNA, 70 bp, Artificial Sequence
  Synthetic
gccaagcatttaggtgacactatagtaacaaaatggtgaagcagtgtttcagagctatgctggaaacagc

SEQ ID NO: 68440 - DNA, 70 bp, Artificial Sequence
  Synthetic
gccaagcatttaggtgacactatagggcccaaatgataatgacttgtttcagagctatgctggaaacagc

SEQ ID NO: 68441 - DNA, 70 bp, Artificial Sequence
  Synthetic
gccaagcatttaggtgacactatagaccgccaccactggggagtagtttcagagctatgctggaaacagc

SEQ ID NO: 68442 - DNA, 70 bp, Artificial Sequence
  Synthetic
gccaagcatttaggtgacactatagtcctgaaacacaagaattgtgtttcagagctatgctggaaacagc

SEQ ID NO: 68443 - DNA, 70 bp, Artificial Sequence
  Synthetic
gccaagcatttaggtgacactatagctgcttcagaacacttactcgtttcagagctatgctggaaacagc

SEQ ID NO: 68444 - DNA, 70 bp, Artificial Sequence
  Synthetic
gccaagcatttaggtgacactatagtcggttctaactaatcacgcgtttcagagctatgctggaaacagc

SEQ ID NO: 68445 - DNA, 70 bp, Artificial Sequence
  Synthetic
gccaagcatttaggtgacactatagggcttctgtccctgctcagtgtttcagagctatgctggaaacagc

SEQ ID NO: 68446 - DNA, 70 bp, Artificial Sequence
  Synthetic
gccaagcatttaggtgacactatagattccgaatatttcggcagtgtttcagagctatgctggaaacagc

SEQ ID NO: 68447 - DNA, 70 bp, Artificial Sequence
  Synthetic
gccaagcatttaggtgacactatagcaaaaagccgaaacggaagcgtttcagagctatgctggaaacagc

SEQ ID NO: 68448 - DNA, 70 bp, Artificial Sequence
  Synthetic
gccaagcatttaggtgacactatagcttggcctttctttctacatgtttcagagctatgctggaaacagc

SEQ ID NO: 68449 - DNA, 70 bp, Artificial Sequence
  Synthetic
gccaagcatttaggtgacactataggtcagagctgctatctgtgcgtttcagagctatgctggaaacagc

SEQ ID NO: 68450 - DNA, 70 bp, Artificial Sequence
  Synthetic
gccaagcatttaggtgacactatagcccaccaagaggaaacgtgtgtttcagagctatgctggaaacagc

SEQ ID NO: 68451 - DNA, 70 bp, Artificial Sequence
  Synthetic
gccaagcatttaggtgacactatagacttctctgagccactgtaagtttcagagctatgctggaaacagc

SEQ ID NO: 68452 - DNA, 70 bp, Artificial Sequence
  Synthetic
gccaagcatttaggtgacactataggatttaagtggtaacctcacgtttcagagctatgctggaaacagc

SEQ ID NO: 68453 - DNA, 70 bp, Artificial Sequence
  Synthetic
gccaagcatttaggtgacactatagcgcccctccagcagaaagtcgtttcagagctatgctggaaacagc

SEQ ID NO: 68454 - DNA, 70 bp, Artificial Sequence
  Synthetic
gccaagcatttaggtgacactataggaagcacaagaagaagcacagtttcagagctatgctggaaacagc

SEQ ID NO: 68455 - DNA, 70 bp, Artificial Sequence
  Synthetic
gccaagcatttaggtgacactatagagtataaagagtgtaggggggtttcagagctatgctggaaacagc

SEQ ID NO: 68456 - DNA, 70 bp, Artificial Sequence
  Synthetic
gccaagcatttaggtgacactatagtgcaagaagtgtggctgtaagtttcagagctatgctggaaacagc

SEQ ID NO: 68457 - DNA, 70 bp, Artificial Sequence
  Synthetic
gccaagcatttaggtgacactataggctggactagatccttactggtttcagagctatgctggaaacagc

SEQ ID NO: 68458 - DNA, 70 bp, Artificial Sequence
  Synthetic
gccaagcatttaggtgacactatagccccccttctaatgatacgtgtttcagagctatgctggaaacagc

SEQ ID NO: 68459 - DNA, 70 bp, Artificial Sequence
  Synthetic
gccaagcatttaggtgacactatagcagtctgagctgtcagagccgtttcagagctatgctggaaacagc

SEQ ID NO: 68460 - DNA, 70 bp, Artificial Sequence
  Synthetic
gccaagcatttaggtgacactatagctgccgtcgcgtgcagtgacgtttcagagctatgctggaaacagc

SEQ ID NO: 68461 - DNA, 70 bp, Artificial Sequence
  Synthetic
gccaagcatttaggtgacactataggcaggcgggtgtttagtgccgtttcagagctatgctggaaacagc

SEQ ID NO: 68462 - DNA, 70 bp, Artificial Sequence
  Synthetic
gccaagcatttaggtgacactatagcttccagatgctggattaccgtttcagagctatgctggaaacagc

SEQ ID NO: 68463 - DNA, 70 bp, Artificial Sequence
  Synthetic
gccaagcatttaggtgacactataggaaagagcccatcaatatctgtttcagagctatgctggaaacagc

SEQ ID NO: 68464 - DNA, 70 bp, Artificial Sequence
  Synthetic
gccaagcatttaggtgacactatagggacccagcaggaatcatgagtttcagagctatgctggaaacagc

SEQ ID NO: 68465 - DNA, 70 bp, Artificial Sequence
  Synthetic
gccaagcatttaggtgacactataggaagaaaaaggagaggtgctgtttcagagctatgctggaaacagc

SEQ ID NO: 68466 - DNA, 70 bp, Artificial Sequence
  Synthetic
gccaagcatttaggtgacactatagacaaaaaggcctctgaataagtttcagagctatgctggaaacagc

SEQ ID NO: 68467 - DNA, 70 bp, Artificial Sequence
  Synthetic
gccaagcatttaggtgacactataggttttgggtttttgcggtttgtttcagagctatgctggaaacagc

SEQ ID NO: 68468 - DNA, 70 bp, Artificial Sequence
  Synthetic
gccaagcatttaggtgacactatagaagcacatatttcagtgatggtttcagagctatgctggaaacagc

SEQ ID NO: 68469 - DNA, 70 bp, Artificial Sequence
  Synthetic
gccaagcatttaggtgacactatagcttccagcctcctgggtcaggtttcagagctatgctggaaacagc

SEQ ID NO: 68470 - DNA, 70 bp, Artificial Sequence
  Synthetic
gccaagcatttaggtgacactatagggcgctgtttgggaagtagcgtttcagagctatgctggaaacagc

SEQ ID NO: 68471 - DNA, 70 bp, Artificial Sequence
  Synthetic
gccaagcatttaggtgacactatagaaaagctggagaatgtattggtttcagagctatgctggaaacagc

SEQ ID NO: 68472 - DNA, 70 bp, Artificial Sequence
  Synthetic
gccaagcatttaggtgacactatagaaacaaactgagaggtaatggtttcagagctatgctggaaacagc

SEQ ID NO: 68473 - DNA, 70 bp, Artificial Sequence
  Synthetic
gccaagcatttaggtgacactataggaggctggtctggcttagctgtttcagagctatgctggaaacagc

SEQ ID NO: 68474 - DNA, 70 bp, Artificial Sequence
  Synthetic
gccaagcatttaggtgacactataggctgctcgggctcacgaaaagtttcagagctatgctggaaacagc

SEQ ID NO: 68475 - DNA, 70 bp, Artificial Sequence
  Synthetic
gccaagcatttaggtgacactatagttcagcactgtcagttttcagtttcagagctatgctggaaacagc

SEQ ID NO: 68476 - DNA, 70 bp, Artificial Sequence
  Synthetic
gccaagcatttaggtgacactatagggagaccctctgggctgagggtttcagagctatgctggaaacagc

SEQ ID NO: 68477 - DNA, 70 bp, Artificial Sequence
  Synthetic
gccaagcatttaggtgacactatagccaggttgcgggtcaggcctgtttcagagctatgctggaaacagc

SEQ ID NO: 68478 - DNA, 70 bp, Artificial Sequence
  Synthetic
gccaagcatttaggtgacactatagggcagcagcccagctgtttagtttcagagctatgctggaaacagc

SEQ ID NO: 68479 - DNA, 70 bp, Artificial Sequence
  Synthetic
gccaagcatttaggtgacactatagctttcacccagccagggagagtttcagagctatgctggaaacagc

SEQ ID NO: 68480 - DNA, 70 bp, Artificial Sequence
  Synthetic
gccaagcatttaggtgacactatagctggggccatgtgggtcacagtttcagagctatgctggaaacagc

SEQ ID NO: 68481 - DNA, 70 bp, Artificial Sequence
  Synthetic
gccaagcatttaggtgacactatagatcatctcttgctgtggaaagtttcagagctatgctggaaacagc

SEQ ID NO: 68482 - DNA, 70 bp, Artificial Sequence
  Synthetic
gccaagcatttaggtgacactataggctcagcaagtatctcagaagtttcagagctatgctggaaacagc

SEQ ID NO: 68483 - DNA, 70 bp, Artificial Sequence
  Synthetic
gccaagcatttaggtgacactatagtctgtgatggcagtgtgagcgtttcagagctatgctggaaacagc

SEQ ID NO: 68484 - DNA, 70 bp, Artificial Sequence
  Synthetic
gccaagcatttaggtgacactatagtaagatgtcgctacaccagcgtttcagagctatgctggaaacagc

SEQ ID NO: 68485 - DNA, 70 bp, Artificial Sequence
  Synthetic
gccaagcatttaggtgacactatagaagtactgagccgtggtcaggtttcagagctatgctggaaacagc

SEQ ID NO: 68486 - DNA, 70 bp, Artificial Sequence
  Synthetic
gccaagcatttaggtgacactataggggacccccggggcgtggtggtttcagagctatgctggaaacagc

SEQ ID NO: 68487 - DNA, 70 bp, Artificial Sequence
  Synthetic
gccaagcatttaggtgacactataggagcaatcctgcattaaccagtttcagagctatgctggaaacagc

SEQ ID NO: 68488 - DNA, 70 bp, Artificial Sequence
  Synthetic
gccaagcatttaggtgacactataggaagaaggcatcgtcaaatcgtttcagagctatgctggaaacagc

SEQ ID NO: 68489 - DNA, 70 bp, Artificial Sequence
  Synthetic
gccaagcatttaggtgacactatagtttctattgccactgttacagtttcagagctatgctggaaacagc

SEQ ID NO: 68490 - DNA, 70 bp, Artificial Sequence
  Synthetic
gccaagcatttaggtgacactatagtccatctgtttagacatgatgtttcagagctatgctggaaacagc

SEQ ID NO: 68491 - DNA, 70 bp, Artificial Sequence
  Synthetic
gccaagcatttaggtgacactatagaagtgagagctccaagcagcgtttcagagctatgctggaaacagc

SEQ ID NO: 68492 - DNA, 70 bp, Artificial Sequence
  Synthetic
gccaagcatttaggtgacactatagggcacttcagacaatgtcctgtttcagagctatgctggaaacagc

SEQ ID NO: 68493 - DNA, 70 bp, Artificial Sequence
  Synthetic
gccaagcatttaggtgacactatagtgcgggctcatcgtggacacgtttcagagctatgctggaaacagc

SEQ ID NO: 68494 - DNA, 70 bp, Artificial Sequence
  Synthetic
gccaagcatttaggtgacactatagaaatccagggacagcctagggtttcagagctatgctggaaacagc

SEQ ID NO: 68495 - DNA, 70 bp, Artificial Sequence
  Synthetic
gccaagcatttaggtgacactatagtggctcttcctggagtcagggtttcagagctatgctggaaacagc

SEQ ID NO: 68496 - DNA, 70 bp, Artificial Sequence
  Synthetic
gccaagcatttaggtgacactatagaaaggacgaggactctgtgggtttcagagctatgctggaaacagc

SEQ ID NO: 68497 - DNA, 70 bp, Artificial Sequence
  Synthetic
gccaagcatttaggtgacactatagcgtaccagtatgtggtctgagtttcagagctatgctggaaacagc

SEQ ID NO: 68498 - DNA, 70 bp, Artificial Sequence
  Synthetic
gccaagcatttaggtgacactatagctgcctttccatgtcatgaggtttcagagctatgctggaaacagc

SEQ ID NO: 68499 - DNA, 70 bp, Artificial Sequence
  Synthetic
gccaagcatttaggtgacactatagtggtaccacctatgagatttgtttcagagctatgctggaaacagc

SEQ ID NO: 68500 - DNA, 70 bp, Artificial Sequence
  Synthetic
gccaagcatttaggtgacactatagctatttttcttctccccctcgtttcagagctatgctggaaacagc

SEQ ID NO: 68501 - DNA, 70 bp, Artificial Sequence
  Synthetic
gccaagcatttaggtgacactatagggcccggagttctcagtgtggtttcagagctatgctggaaacagc

SEQ ID NO: 68502 - DNA, 70 bp, Artificial Sequence
  Synthetic
gccaagcatttaggtgacactatagacctacgagatctcggtgtggtttcagagctatgctggaaacagc

SEQ ID NO: 68503 - DNA, 70 bp, Artificial Sequence
  Synthetic
gccaagcatttaggtgacactatagcagcctctcggggccctagcgtttcagagctatgctggaaacagc

SEQ ID NO: 68504 - DNA, 70 bp, Artificial Sequence
  Synthetic
gccaagcatttaggtgacactatagtcagcttcagctgcctcctggtttcagagctatgctggaaacagc

SEQ ID NO: 68505 - DNA, 70 bp, Artificial Sequence
  Synthetic
gccaagcatttaggtgacactatagagcagcttaggacaaaaagtgtttcagagctatgctggaaacagc

SEQ ID NO: 68506 - DNA, 70 bp, Artificial Sequence
  Synthetic
gccaagcatttaggtgacactataggaggaagacaatatggaagagtttcagagctatgctggaaacagc

SEQ ID NO: 68507 - DNA, 70 bp, Artificial Sequence
  Synthetic
gccaagcatttaggtgacactatagacatggacacgtctagataggtttcagagctatgctggaaacagc

SEQ ID NO: 68508 - DNA, 70 bp, Artificial Sequence
  Synthetic
gccaagcatttaggtgacactatagactttgccgcttctctagccgtttcagagctatgctggaaacagc

SEQ ID NO: 68509 - DNA, 70 bp, Artificial Sequence
  Synthetic
gccaagcatttaggtgacactatagggaaacctggattgctaagggtttcagagctatgctggaaacagc

SEQ ID NO: 68510 - DNA, 70 bp, Artificial Sequence
  Synthetic
gccaagcatttaggtgacactataggtcgccccaccatcaaagctgtttcagagctatgctggaaacagc

SEQ ID NO: 68511 - DNA, 70 bp, Artificial Sequence
  Synthetic
gccaagcatttaggtgacactatagtccaactgcagcctgtgctagtttcagagctatgctggaaacagc

SEQ ID NO: 68512 - DNA, 70 bp, Artificial Sequence
  Synthetic
gccaagcatttaggtgacactatagtcggggaggggtgctcctgagtttcagagctatgctggaaacagc

SEQ ID NO: 68513 - DNA, 70 bp, Artificial Sequence
  Synthetic
gccaagcatttaggtgacactatagagctttggtgcattaaccacgtttcagagctatgctggaaacagc

SEQ ID NO: 68514 - DNA, 70 bp, Artificial Sequence
  Synthetic
gccaagcatttaggtgacactatagaaaagagaatccagttgttggtttcagagctatgctggaaacagc

SEQ ID NO: 68515 - DNA, 70 bp, Artificial Sequence
  Synthetic
gccaagcatttaggtgacactatagcagcaggagttcaaatctttgtttcagagctatgctggaaacagc

SEQ ID NO: 68516 - DNA, 70 bp, Artificial Sequence
  Synthetic
gccaagcatttaggtgacactatagagccggcccaggaactctaggtttcagagctatgctggaaacagc

SEQ ID NO: 68517 - DNA, 70 bp, Artificial Sequence
  Synthetic
gccaagcatttaggtgacactataggtttccaagtgccaagagatgtttcagagctatgctggaaacagc

SEQ ID NO: 68518 - DNA, 70 bp, Artificial Sequence
  Synthetic
gccaagcatttaggtgacactataggtagaggtagtcgtagttttgtttcagagctatgctggaaacagc

SEQ ID NO: 68519 - DNA, 70 bp, Artificial Sequence
  Synthetic
gccaagcatttaggtgacactatagtggtctgaccagtgtaggaagtttcagagctatgctggaaacagc

SEQ ID NO: 68520 - DNA, 70 bp, Artificial Sequence
  Synthetic
gccaagcatttaggtgacactatagaatggatatgttcagtgtgtgtttcagagctatgctggaaacagc

SEQ ID NO: 68521 - DNA, 70 bp, Artificial Sequence
  Synthetic
gccaagcatttaggtgacactatagccatcagagagttcacatcggtttcagagctatgctggaaacagc

SEQ ID NO: 68522 - DNA, 70 bp, Artificial Sequence
  Synthetic
gccaagcatttaggtgacactataggaatcttctgatgctgagtagtttcagagctatgctggaaacagc

SEQ ID NO: 68523 - DNA, 70 bp, Artificial Sequence
  Synthetic
gccaagcatttaggtgacactatagcatcaaagaactcatacgtggtttcagagctatgctggaaacagc

SEQ ID NO: 68524 - DNA, 70 bp, Artificial Sequence
  Synthetic
gccaagcatttaggtgacactatagacgtctcgaggctatggtgagtttcagagctatgctggaaacagc

SEQ ID NO: 68525 - DNA, 70 bp, Artificial Sequence
  Synthetic
gccaagcatttaggtgacactatagaggaggaggaaagaattattgtttcagagctatgctggaaacagc

SEQ ID NO: 68526 - DNA, 70 bp, Artificial Sequence
  Synthetic
gccaagcatttaggtgacactatagacatcaaagtgttcactgtagtttcagagctatgctggaaacagc

SEQ ID NO: 68527 - DNA, 70 bp, Artificial Sequence
  Synthetic
gccaagcatttaggtgacactatagtgactgtaaggaatgtggaagtttcagagctatgctggaaacagc

SEQ ID NO: 68528 - DNA, 70 bp, Artificial Sequence
  Synthetic
gccaagcatttaggtgacactatagaacagagatgcgattgaagagtttcagagctatgctggaaacagc

SEQ ID NO: 68529 - DNA, 70 bp, Artificial Sequence
  Synthetic
gccaagcatttaggtgacactatagcctggcttagtcatctgagagtttcagagctatgctggaaacagc

SEQ ID NO: 68530 - DNA, 70 bp, Artificial Sequence
  Synthetic
gccaagcatttaggtgacactatagctctccatctccgacgactggtttcagagctatgctggaaacagc

SEQ ID NO: 68531 - DNA, 70 bp, Artificial Sequence
  Synthetic
gccaagcatttaggtgacactatagcatagggtttttctccagtggtttcagagctatgctggaaacagc

SEQ ID NO: 68532 - DNA, 70 bp, Artificial Sequence
  Synthetic
gccaagcatttaggtgacactatagcctcggaagaagccctgagcgtttcagagctatgctggaaacagc

SEQ ID NO: 68533 - DNA, 70 bp, Artificial Sequence
  Synthetic
gccaagcatttaggtgacactatagacgaacaagaatgaacaagagtttcagagctatgctggaaacagc

SEQ ID NO: 68534 - DNA, 70 bp, Artificial Sequence
  Synthetic
gccaagcatttaggtgacactatagcaaaggagacaaaacaaagggtttcagagctatgctggaaacagc

SEQ ID NO: 68535 - DNA, 70 bp, Artificial Sequence
  Synthetic
gccaagcatttaggtgacactataggatgaggatgcctctgtagcgtttcagagctatgctggaaacagc

SEQ ID NO: 68536 - DNA, 70 bp, Artificial Sequence
  Synthetic
gccaagcatttaggtgacactataggcactaatctggaatggagtgtttcagagctatgctggaaacagc

SEQ ID NO: 68537 - DNA, 70 bp, Artificial Sequence
  Synthetic
gccaagcatttaggtgacactatagaccctcttcggctgagctaggtttcagagctatgctggaaacagc

SEQ ID NO: 68538 - DNA, 70 bp, Artificial Sequence
  Synthetic
gccaagcatttaggtgacactataggaggaacgccttccgaaatagtttcagagctatgctggaaacagc

SEQ ID NO: 68539 - DNA, 70 bp, Artificial Sequence
  Synthetic
gccaagcatttaggtgacactatagatttcacacaacattgctgagtttcagagctatgctggaaacagc

SEQ ID NO: 68540 - DNA, 70 bp, Artificial Sequence
  Synthetic
gccaagcatttaggtgacactatagaaggtgtgaatgttgcctaagtttcagagctatgctggaaacagc

SEQ ID NO: 68541 - DNA, 70 bp, Artificial Sequence
  Synthetic
gccaagcatttaggtgacactatagcagctggttacaaagcatgagtttcagagctatgctggaaacagc

SEQ ID NO: 68542 - DNA, 70 bp, Artificial Sequence
  Synthetic
gccaagcatttaggtgacactatagccttggaaagttgtgaggaagtttcagagctatgctggaaacagc

SEQ ID NO: 68543 - DNA, 70 bp, Artificial Sequence
  Synthetic
gccaagcatttaggtgacactatagcattcttgctgacatcactcgtttcagagctatgctggaaacagc

SEQ ID NO: 68544 - DNA, 70 bp, Artificial Sequence
  Synthetic
gccaagcatttaggtgacactatagccctattcttgtaaggaatggtttcagagctatgctggaaacagc

SEQ ID NO: 68545 - DNA, 70 bp, Artificial Sequence
  Synthetic
gccaagcatttaggtgacactatagcagactctgccggaccttaggtttcagagctatgctggaaacagc

SEQ ID NO: 68546 - DNA, 70 bp, Artificial Sequence
  Synthetic
gccaagcatttaggtgacactatagcagcggcggctgggcctggagtttcagagctatgctggaaacagc

SEQ ID NO: 68547 - DNA, 70 bp, Artificial Sequence
  Synthetic
gccaagcatttaggtgacactatagcacaagcaagggggctcagggtttcagagctatgctggaaacagc

SEQ ID NO: 68548 - DNA, 70 bp, Artificial Sequence
  Synthetic
gccaagcatttaggtgacactataggggcgctcacttcacgtgctgtttcagagctatgctggaaacagc

SEQ ID NO: 68549 - DNA, 70 bp, Artificial Sequence
  Synthetic
gccaagcatttaggtgacactatagagtttgaaaggttgttgaacgtttcagagctatgctggaaacagc

SEQ ID NO: 68550 - DNA, 70 bp, Artificial Sequence
  Synthetic
gccaagcatttaggtgacactatagttgatggatttgaagctgaggtttcagagctatgctggaaacagc

SEQ ID NO: 68551 - DNA, 70 bp, Artificial Sequence
  Synthetic
gccaagcatttaggtgacactatagccagccttgggtccttcaccgtttcagagctatgctggaaacagc

SEQ ID NO: 68552 - DNA, 70 bp, Artificial Sequence
  Synthetic
gccaagcatttaggtgacactatagggggccggcggggcggagaggtttcagagctatgctggaaacagc

SEQ ID NO: 68553 - DNA, 70 bp, Artificial Sequence
  Synthetic
gccaagcatttaggtgacactatagcgtgctctgcgagctctcaggtttcagagctatgctggaaacagc

SEQ ID NO: 68554 - DNA, 70 bp, Artificial Sequence
  Synthetic
gccaagcatttaggtgacactatagtgtagaagtattgttagggcgtttcagagctatgctggaaacagc

SEQ ID NO: 68555 - DNA, 70 bp, Artificial Sequence
  Synthetic
gccaagcatttaggtgacactatagatgagacaccataaagaagtgtttcagagctatgctggaaacagc

SEQ ID NO: 68556 - DNA, 70 bp, Artificial Sequence
  Synthetic
gccaagcatttaggtgacactatagggagagggggctggggttaagtttcagagctatgctggaaacagc

SEQ ID NO: 68557 - DNA, 70 bp, Artificial Sequence
  Synthetic
gccaagcatttaggtgacactatagtaatggtaaactagagttgggtttcagagctatgctggaaacagc

SEQ ID NO: 68558 - DNA, 70 bp, Artificial Sequence
  Synthetic
gccaagcatttaggtgacactatagtttgtggtgtctgttgtaatgtttcagagctatgctggaaacagc

SEQ ID NO: 68559 - DNA, 70 bp, Artificial Sequence
  Synthetic
gccaagcatttaggtgacactatagcagggtgtcttcagtgctctgtttcagagctatgctggaaacagc

SEQ ID NO: 68560 - DNA, 70 bp, Artificial Sequence
  Synthetic
gccaagcatttaggtgacactatagtcagccccacgtagagttacgtttcagagctatgctggaaacagc

SEQ ID NO: 68561 - DNA, 70 bp, Artificial Sequence
  Synthetic
gccaagcatttaggtgacactatagcactgcccaaggtcacttccgtttcagagctatgctggaaacagc

SEQ ID NO: 68562 - DNA, 70 bp, Artificial Sequence
  Synthetic
gccaagcatttaggtgacactatagcctctcttctcacttgctcagtttcagagctatgctggaaacagc

SEQ ID NO: 68563 - DNA, 70 bp, Artificial Sequence
  Synthetic
gccaagcatttaggtgacactatagacggtgcaggcagatcacgggtttcagagctatgctggaaacagc

SEQ ID NO: 68564 - DNA, 70 bp, Artificial Sequence
  Synthetic
gccaagcatttaggtgacactatagaattcatgtggaactgcaatgtttcagagctatgctggaaacagc

SEQ ID NO: 68565 - DNA, 70 bp, Artificial Sequence
  Synthetic
gccaagcatttaggtgacactatagcatgttcagcatccccaggcgtttcagagctatgctggaaacagc

SEQ ID NO: 68566 - DNA, 70 bp, Artificial Sequence
  Synthetic
gccaagcatttaggtgacactataggacaaggccggcctgtgacggtttcagagctatgctggaaacagc

SEQ ID NO: 68567 - DNA, 70 bp, Artificial Sequence
  Synthetic
gccaagcatttaggtgacactatagtagtgagggccccgttgtcagtttcagagctatgctggaaacagc

SEQ ID NO: 68568 - DNA, 70 bp, Artificial Sequence
  Synthetic
gccaagcatttaggtgacactatagtggggtaaacatcccagtgcgtttcagagctatgctggaaacagc

SEQ ID NO: 68569 - DNA, 70 bp, Artificial Sequence
  Synthetic
gccaagcatttaggtgacactatagtcacccgtgggtcgctaggggtttcagagctatgctggaaacagc

SEQ ID NO: 68570 - DNA, 70 bp, Artificial Sequence
  Synthetic
gccaagcatttaggtgacactatagtccctggaccccattcaggagtttcagagctatgctggaaacagc

SEQ ID NO: 68571 - DNA, 70 bp, Artificial Sequence
  Synthetic
gccaagcatttaggtgacactatagagaactcagtcatcttcttggtttcagagctatgctggaaacagc

SEQ ID NO: 68572 - DNA, 70 bp, Artificial Sequence
  Synthetic
gccaagcatttaggtgacactatagttaaggagatggttcagctggtttcagagctatgctggaaacagc

SEQ ID NO: 68573 - DNA, 70 bp, Artificial Sequence
  Synthetic
gccaagcatttaggtgacactatagaacctccacgacatgtgaaagtttcagagctatgctggaaacagc

SEQ ID NO: 68574 - DNA, 70 bp, Artificial Sequence
  Synthetic
gccaagcatttaggtgacactatagcttcgtttcacataaacccggtttcagagctatgctggaaacagc

SEQ ID NO: 68575 - DNA, 70 bp, Artificial Sequence
  Synthetic
gccaagcatttaggtgacactataggaggctggccaggcctagacgtttcagagctatgctggaaacagc

SEQ ID NO: 68576 - DNA, 70 bp, Artificial Sequence
  Synthetic
gccaagcatttaggtgacactataggacacatcgagtccccaggcgtttcagagctatgctggaaacagc

SEQ ID NO: 68577 - DNA, 70 bp, Artificial Sequence
  Synthetic
gccaagcatttaggtgacactatagaattggaagagagcgcactggtttcagagctatgctggaaacagc

SEQ ID NO: 68578 - DNA, 70 bp, Artificial Sequence
  Synthetic
gccaagcatttaggtgacactatagcaatgaatggtacgtgtgacgtttcagagctatgctggaaacagc

SEQ ID NO: 68579 - DNA, 70 bp, Artificial Sequence
  Synthetic
gccaagcatttaggtgacactatagcatttcttgcacagtaggttgtttcagagctatgctggaaacagc

SEQ ID NO: 68580 - DNA, 70 bp, Artificial Sequence
  Synthetic
gccaagcatttaggtgacactatagtttaacgaatggtacgtctggtttcagagctatgctggaaacagc

SEQ ID NO: 68581 - DNA, 70 bp, Artificial Sequence
  Synthetic
gccaagcatttaggtgacactatagggcctcctcggcggcggtgggtttcagagctatgctggaaacagc

SEQ ID NO: 68582 - DNA, 70 bp, Artificial Sequence
  Synthetic
gccaagcatttaggtgacactatagacgggaaccctgaagttgtggtttcagagctatgctggaaacagc

SEQ ID NO: 68583 - DNA, 70 bp, Artificial Sequence
  Synthetic
gccaagcatttaggtgacactatagtttttggtgatgtatgaggcgtttcagagctatgctggaaacagc

SEQ ID NO: 68584 - DNA, 70 bp, Artificial Sequence
  Synthetic
gccaagcatttaggtgacactatagggagttgataatgttgagtggtttcagagctatgctggaaacagc

SEQ ID NO: 68585 - DNA, 70 bp, Artificial Sequence
  Synthetic
gccaagcatttaggtgacactatagaagtgcatggggctcctatcgtttcagagctatgctggaaacagc

SEQ ID NO: 68586 - DNA, 70 bp, Artificial Sequence
  Synthetic
gccaagcatttaggtgacactatagcagctgatggcagcaaaaatgtttcagagctatgctggaaacagc

SEQ ID NO: 68587 - DNA, 70 bp, Artificial Sequence
  Synthetic
gccaagcatttaggtgacactatagtcctgaaaagttgtgtgtaagtttcagagctatgctggaaacagc

SEQ ID NO: 68588 - DNA, 70 bp, Artificial Sequence
  Synthetic
gccaagcatttaggtgacactatagagggaaagactgatgaatttgtttcagagctatgctggaaacagc

SEQ ID NO: 68589 - DNA, 70 bp, Artificial Sequence
  Synthetic
gccaagcatttaggtgacactatagatggcatgggtcactgtgatgtttcagagctatgctggaaacagc

SEQ ID NO: 68590 - DNA, 70 bp, Artificial Sequence
  Synthetic
gccaagcatttaggtgacactatagaacatcagagaagccatgtagtttcagagctatgctggaaacagc

SEQ ID NO: 68591 - DNA, 70 bp, Artificial Sequence
  Synthetic
gccaagcatttaggtgacactatagcagagacccctctacacttagtttcagagctatgctggaaacagc

SEQ ID NO: 68592 - DNA, 70 bp, Artificial Sequence
  Synthetic
gccaagcatttaggtgacactatagcaccatagcatggcctccttgtttcagagctatgctggaaacagc

SEQ ID NO: 68593 - DNA, 70 bp, Artificial Sequence
  Synthetic
gccaagcatttaggtgacactatagcgacatcaggtcctgcacacgtttcagagctatgctggaaacagc

SEQ ID NO: 68594 - DNA, 70 bp, Artificial Sequence
  Synthetic
gccaagcatttaggtgacactatagctggcttggtcagtttcttagtttcagagctatgctggaaacagc

SEQ ID NO: 68595 - DNA, 70 bp, Artificial Sequence
  Synthetic
gccaagcatttaggtgacactatagatctgaatccataagcgtttgtttcagagctatgctggaaacagc

SEQ ID NO: 68596 - DNA, 70 bp, Artificial Sequence
  Synthetic
gccaagcatttaggtgacactatagctttgggatgagtctattctgtttcagagctatgctggaaacagc

SEQ ID NO: 68597 - DNA, 70 bp, Artificial Sequence
  Synthetic
gccaagcatttaggtgacactatagtccaccaagaagagttactggtttcagagctatgctggaaacagc

SEQ ID NO: 68598 - DNA, 70 bp, Artificial Sequence
  Synthetic
gccaagcatttaggtgacactatagaggaatgagatggagaatctgtttcagagctatgctggaaacagc

SEQ ID NO: 68599 - DNA, 70 bp, Artificial Sequence
  Synthetic
gccaagcatttaggtgacactatagcagtatcatgcccatctgaagtttcagagctatgctggaaacagc

SEQ ID NO: 68600 - DNA, 70 bp, Artificial Sequence
  Synthetic
gccaagcatttaggtgacactatagggcaaggggctcagccccacgtttcagagctatgctggaaacagc

SEQ ID NO: 68601 - DNA, 70 bp, Artificial Sequence
  Synthetic
gccaagcatttaggtgacactatagtctctatttgagaacaactggtttcagagctatgctggaaacagc

SEQ ID NO: 68602 - DNA, 70 bp, Artificial Sequence
  Synthetic
gccaagcatttaggtgacactatagtgttctcaaacagagaaagcgtttcagagctatgctggaaacagc

SEQ ID NO: 68603 - DNA, 70 bp, Artificial Sequence
  Synthetic
gccaagcatttaggtgacactataggcttgaagtctctctagcaggtttcagagctatgctggaaacagc

SEQ ID NO: 68604 - DNA, 70 bp, Artificial Sequence
  Synthetic
gccaagcatttaggtgacactatagaatggctgttgagcaggagtgtttcagagctatgctggaaacagc

SEQ ID NO: 68605 - DNA, 70 bp, Artificial Sequence
  Synthetic
gccaagcatttaggtgacactatagccgtacaagcatattttccagtttcagagctatgctggaaacagc

SEQ ID NO: 68606 - DNA, 70 bp, Artificial Sequence
  Synthetic
gccaagcatttaggtgacactatagcctttgccttggaatacagggtttcagagctatgctggaaacagc

SEQ ID NO: 68607 - DNA, 70 bp, Artificial Sequence
  Synthetic
gccaagcatttaggtgacactatagatggcacacgagctcagtccgtttcagagctatgctggaaacagc

SEQ ID NO: 68608 - DNA, 70 bp, Artificial Sequence
  Synthetic
gccaagcatttaggtgacactatagcctctaatgcactactccctgtttcagagctatgctggaaacagc

SEQ ID NO: 68609 - DNA, 70 bp, Artificial Sequence
  Synthetic
gccaagcatttaggtgacactatagaacatcagagtcttcagattgtttcagagctatgctggaaacagc

SEQ ID NO: 68610 - DNA, 70 bp, Artificial Sequence
  Synthetic
gccaagcatttaggtgacactatagaaggatttgcttgattctacgtttcagagctatgctggaaacagc

SEQ ID NO: 68611 - DNA, 70 bp, Artificial Sequence
  Synthetic
gccaagcatttaggtgacactatagatgaaaatgggtgcaaagatgtttcagagctatgctggaaacagc

SEQ ID NO: 68612 - DNA, 70 bp, Artificial Sequence
  Synthetic
gccaagcatttaggtgacactatagtctacataatgcacgtgttcgtttcagagctatgctggaaacagc

SEQ ID NO: 68613 - DNA, 70 bp, Artificial Sequence
  Synthetic
gccaagcatttaggtgacactatagaagatgtgactgcaagtcttgtttcagagctatgctggaaacagc

SEQ ID NO: 68614 - DNA, 70 bp, Artificial Sequence
  Synthetic
gccaagcatttaggtgacactatagcagcaactgcagccctcattgtttcagagctatgctggaaacagc

SEQ ID NO: 68615 - DNA, 70 bp, Artificial Sequence
  Synthetic
gccaagcatttaggtgacactatagagggccagcttcatcttttcgtttcagagctatgctggaaacagc

SEQ ID NO: 68616 - DNA, 70 bp, Artificial Sequence
  Synthetic
gccaagcatttaggtgacactatagtcagaccaagaagaagcagtgtttcagagctatgctggaaacagc

SEQ ID NO: 68617 - DNA, 70 bp, Artificial Sequence
  Synthetic
gccaagcatttaggtgacactataggctcatgggtcactaagtaagtttcagagctatgctggaaacagc

SEQ ID NO: 68618 - DNA, 70 bp, Artificial Sequence
  Synthetic
gccaagcatttaggtgacactataggtatcagcattcatttccgcgtttcagagctatgctggaaacagc

SEQ ID NO: 68619 - DNA, 70 bp, Artificial Sequence
  Synthetic
gccaagcatttaggtgacactataggcttgagccagagcgatgacgtttcagagctatgctggaaacagc

SEQ ID NO: 68620 - DNA, 70 bp, Artificial Sequence
  Synthetic
gccaagcatttaggtgacactatagctggttttgtcctgaatgtggtttcagagctatgctggaaacagc

SEQ ID NO: 68621 - DNA, 70 bp, Artificial Sequence
  Synthetic
gccaagcatttaggtgacactataggattcactgctagtcccagagtttcagagctatgctggaaacagc

SEQ ID NO: 68622 - DNA, 70 bp, Artificial Sequence
  Synthetic
gccaagcatttaggtgacactatagctggtatccaataaggttaggtttcagagctatgctggaaacagc

SEQ ID NO: 68623 - DNA, 70 bp, Artificial Sequence
  Synthetic
gccaagcatttaggtgacactataggtttaataaggcttagggacgtttcagagctatgctggaaacagc

SEQ ID NO: 68624 - DNA, 70 bp, Artificial Sequence
  Synthetic
gccaagcatttaggtgacactataggtgctttggcaggaggcagggtttcagagctatgctggaaacagc

SEQ ID NO: 68625 - DNA, 70 bp, Artificial Sequence
  Synthetic
gccaagcatttaggtgacactatagtgctaggaaaggatccaaacgtttcagagctatgctggaaacagc

SEQ ID NO: 68626 - DNA, 70 bp, Artificial Sequence
  Synthetic
gccaagcatttaggtgacactatagaaaccctacaaatgtgagtagtttcagagctatgctggaaacagc

SEQ ID NO: 68627 - DNA, 70 bp, Artificial Sequence
  Synthetic
gccaagcatttaggtgacactatagctgtgtagattctctgatgagtttcagagctatgctggaaacagc

SEQ ID NO: 68628 - DNA, 70 bp, Artificial Sequence
  Synthetic
gccaagcatttaggtgacactatagtgagaagccctgtgaatgaagtttcagagctatgctggaaacagc

SEQ ID NO: 68629 - DNA, 70 bp, Artificial Sequence
  Synthetic
gccaagcatttaggtgacactatagaaccgatcttcaacccttatgtttcagagctatgctggaaacagc

SEQ ID NO: 68630 - DNA, 70 bp, Artificial Sequence
  Synthetic
gccaagcatttaggtgacactatagtgaatgtaatagatgtgggagtttcagagctatgctggaaacagc

SEQ ID NO: 68631 - DNA, 70 bp, Artificial Sequence
  Synthetic
gccaagcatttaggtgacactatagtctgtagatgtgaagaagcagtttcagagctatgctggaaacagc

SEQ ID NO: 68632 - DNA, 70 bp, Artificial Sequence
  Synthetic
gccaagcatttaggtgacactatagttagtcgtgctagtacccttgtttcagagctatgctggaaacagc

SEQ ID NO: 68633 - DNA, 70 bp, Artificial Sequence
  Synthetic
gccaagcatttaggtgacactatagcagagagatgtttctgctgagtttcagagctatgctggaaacagc

SEQ ID NO: 68634 - DNA, 70 bp, Artificial Sequence
  Synthetic
gccaagcatttaggtgacactatagtgtactgatcttcaatgctcgtttcagagctatgctggaaacagc

SEQ ID NO: 68635 - DNA, 70 bp, Artificial Sequence
  Synthetic
gccaagcatttaggtgacactatagagcagaaaaggcagagaatggtttcagagctatgctggaaacagc

SEQ ID NO: 68636 - DNA, 70 bp, Artificial Sequence
  Synthetic
gccaagcatttaggtgacactataggctgtgcaaggttacaaagagtttcagagctatgctggaaacagc

SEQ ID NO: 68637 - DNA, 70 bp, Artificial Sequence
  Synthetic
gccaagcatttaggtgacactatagattccttatactctctctgagtttcagagctatgctggaaacagc

SEQ ID NO: 68638 - DNA, 70 bp, Artificial Sequence
  Synthetic
gccaagcatttaggtgacactatagtcacactgcaggcaggctttgtttcagagctatgctggaaacagc

SEQ ID NO: 68639 - DNA, 70 bp, Artificial Sequence
  Synthetic
gccaagcatttaggtgacactatagaagcaccagagaactcacacgtttcagagctatgctggaaacagc

SEQ ID NO: 68640 - DNA, 70 bp, Artificial Sequence
  Synthetic
gccaagcatttaggtgacactataggaattagagagcagatgcaggtttcagagctatgctggaaacagc

SEQ ID NO: 68641 - DNA, 70 bp, Artificial Sequence
  Synthetic
gccaagcatttaggtgacactatagacatgaacccagagcattaagtttcagagctatgctggaaacagc

SEQ ID NO: 68642 - DNA, 70 bp, Artificial Sequence
  Synthetic
gccaagcatttaggtgacactatagccatacaaatgtgaggaatggtttcagagctatgctggaaacagc

SEQ ID NO: 68643 - DNA, 70 bp, Artificial Sequence
  Synthetic
gccaagcatttaggtgacactatagctgcatgaaaggactcatatgtttcagagctatgctggaaacagc

SEQ ID NO: 68644 - DNA, 70 bp, Artificial Sequence
  Synthetic
gccaagcatttaggtgacactatagtctttgcagtgtaaattcacgtttcagagctatgctggaaacagc

SEQ ID NO: 68645 - DNA, 70 bp, Artificial Sequence
  Synthetic
gccaagcatttaggtgacactatagggcgggcgaatcacgaagtcgtttcagagctatgctggaaacagc

SEQ ID NO: 68646 - DNA, 70 bp, Artificial Sequence
  Synthetic
gccaagcatttaggtgacactatagcaggtgtgagaaccgtttaagtttcagagctatgctggaaacagc

SEQ ID NO: 68647 - DNA, 70 bp, Artificial Sequence
  Synthetic
gccaagcatttaggtgacactatagtaaaaattagccaggtgtgggtttcagagctatgctggaaacagc

SEQ ID NO: 68648 - DNA, 70 bp, Artificial Sequence
  Synthetic
gccaagcatttaggtgacactatagtgggcttgttgtcatagagagtttcagagctatgctggaaacagc

SEQ ID NO: 68649 - DNA, 70 bp, Artificial Sequence
  Synthetic
gccaagcatttaggtgacactatagggggcaggctttcagccctcgtttcagagctatgctggaaacagc

SEQ ID NO: 68650 - DNA, 70 bp, Artificial Sequence
  Synthetic
gccaagcatttaggtgacactataggaggattaatcatccaacccgtttcagagctatgctggaaacagc

SEQ ID NO: 68651 - DNA, 70 bp, Artificial Sequence
  Synthetic
gccaagcatttaggtgacactataggtctaatgtggtgtgacttcgtttcagagctatgctggaaacagc

SEQ ID NO: 68652 - DNA, 70 bp, Artificial Sequence
  Synthetic
gccaagcatttaggtgacactatagagacatgagaagattcatacgtttcagagctatgctggaaacagc

SEQ ID NO: 68653 - DNA, 70 bp, Artificial Sequence
  Synthetic
gccaagcatttaggtgacactataggccacaactggccagactttgtttcagagctatgctggaaacagc

SEQ ID NO: 68654 - DNA, 70 bp, Artificial Sequence
  Synthetic
gccaagcatttaggtgacactatagtctctgatgtttaataaggcgtttcagagctatgctggaaacagc

SEQ ID NO: 68655 - DNA, 70 bp, Artificial Sequence
  Synthetic
gccaagcatttaggtgacactatagctacaagaggcgcttgaatcgtttcagagctatgctggaaacagc

SEQ ID NO: 68656 - DNA, 70 bp, Artificial Sequence
  Synthetic
gccaagcatttaggtgacactatagtgagggaagtcttcagtgaggtttcagagctatgctggaaacagc

SEQ ID NO: 68657 - DNA, 70 bp, Artificial Sequence
  Synthetic
gccaagcatttaggtgacactataggttgattcacaccagggaatgtttcagagctatgctggaaacagc

SEQ ID NO: 68658 - DNA, 70 bp, Artificial Sequence
  Synthetic
gccaagcatttaggtgacactatagcctcaccacactcatttgtagtttcagagctatgctggaaacagc

SEQ ID NO: 68659 - DNA, 70 bp, Artificial Sequence
  Synthetic
gccaagcatttaggtgacactatagggggtgtgtgataagcgagtgtttcagagctatgctggaaacagc

SEQ ID NO: 68660 - DNA, 70 bp, Artificial Sequence
  Synthetic
gccaagcatttaggtgacactatagacaccagagaattcacatgagtttcagagctatgctggaaacagc

SEQ ID NO: 68661 - DNA, 70 bp, Artificial Sequence
  Synthetic
gccaagcatttaggtgacactatagggaaaggtcagaagacctctgtttcagagctatgctggaaacagc

SEQ ID NO: 68662 - DNA, 70 bp, Artificial Sequence
  Synthetic
gccaagcatttaggtgacactatagtttatctggtgtgaactttcgtttcagagctatgctggaaacagc

SEQ ID NO: 68663 - DNA, 70 bp, Artificial Sequence
  Synthetic
gccaagcatttaggtgacactatagacttcaccatggggactaaagtttcagagctatgctggaaacagc

SEQ ID NO: 68664 - DNA, 70 bp, Artificial Sequence
  Synthetic
gccaagcatttaggtgacactatagatgaacttccatgcaagctagtttcagagctatgctggaaacagc

SEQ ID NO: 68665 - DNA, 70 bp, Artificial Sequence
  Synthetic
gccaagcatttaggtgacactatagtgtatctcatggttctgcaagtttcagagctatgctggaaacagc

SEQ ID NO: 68666 - DNA, 70 bp, Artificial Sequence
  Synthetic
gccaagcatttaggtgacactatagtgcactaggaattcattgctgtttcagagctatgctggaaacagc

SEQ ID NO: 68667 - DNA, 70 bp, Artificial Sequence
  Synthetic
gccaagcatttaggtgacactatagtttggttactggctattgaagtttcagagctatgctggaaacagc

SEQ ID NO: 68668 - DNA, 70 bp, Artificial Sequence
  Synthetic
gccaagcatttaggtgacactatagccctttacatgtattcagtggtttcagagctatgctggaaacagc

SEQ ID NO: 68669 - DNA, 70 bp, Artificial Sequence
  Synthetic
gccaagcatttaggtgacactatagacccaatagtgtggtaagtggtttcagagctatgctggaaacagc

SEQ ID NO: 68670 - DNA, 70 bp, Artificial Sequence
  Synthetic
gccaagcatttaggtgacactatagcactcggaagtcaaagttcagtttcagagctatgctggaaacagc

SEQ ID NO: 68671 - DNA, 70 bp, Artificial Sequence
  Synthetic
gccaagcatttaggtgacactatagtcctagaattgtcatatgccgtttcagagctatgctggaaacagc

SEQ ID NO: 68672 - DNA, 70 bp, Artificial Sequence
  Synthetic
gccaagcatttaggtgacactatagaccgtgacaccattcactgtgtttcagagctatgctggaaacagc

SEQ ID NO: 68673 - DNA, 70 bp, Artificial Sequence
  Synthetic
gccaagcatttaggtgacactatagatcagaaattgcacacagcagtttcagagctatgctggaaacagc

SEQ ID NO: 68674 - DNA, 70 bp, Artificial Sequence
  Synthetic
gccaagcatttaggtgacactatagagggggtaaaaaattctggggtttcagagctatgctggaaacagc

SEQ ID NO: 68675 - DNA, 70 bp, Artificial Sequence
  Synthetic
gccaagcatttaggtgacactataggaatgctttcatgtacagtcgtttcagagctatgctggaaacagc

SEQ ID NO: 68676 - DNA, 70 bp, Artificial Sequence
  Synthetic
gccaagcatttaggtgacactatagaaacagggaatagactgagtgtttcagagctatgctggaaacagc

SEQ ID NO: 68677 - DNA, 70 bp, Artificial Sequence
  Synthetic
gccaagcatttaggtgacactatagttcatgttctcgacatgaacgtttcagagctatgctggaaacagc

SEQ ID NO: 68678 - DNA, 70 bp, Artificial Sequence
  Synthetic
gccaagcatttaggtgacactatagcccagtattacttctgctttgtttcagagctatgctggaaacagc

SEQ ID NO: 68679 - DNA, 70 bp, Artificial Sequence
  Synthetic
gccaagcatttaggtgacactatagtcagaaaagacctcctagctgtttcagagctatgctggaaacagc

SEQ ID NO: 68680 - DNA, 70 bp, Artificial Sequence
  Synthetic
gccaagcatttaggtgacactatagcccacccgctcccacctagggtttcagagctatgctggaaacagc

SEQ ID NO: 68681 - DNA, 70 bp, Artificial Sequence
  Synthetic
gccaagcatttaggtgacactatagcctcctgtaatgtcgcaagggtttcagagctatgctggaaacagc

SEQ ID NO: 68682 - DNA, 70 bp, Artificial Sequence
  Synthetic
gccaagcatttaggtgacactataggaagactgataaccagctgagtttcagagctatgctggaaacagc

SEQ ID NO: 68683 - DNA, 70 bp, Artificial Sequence
  Synthetic
gccaagcatttaggtgacactatagtagaaagagttgatgagtctgtttcagagctatgctggaaacagc

SEQ ID NO: 68684 - DNA, 70 bp, Artificial Sequence
  Synthetic
gccaagcatttaggtgacactatagtatactgactggtctcattcgtttcagagctatgctggaaacagc

SEQ ID NO: 68685 - DNA, 70 bp, Artificial Sequence
  Synthetic
gccaagcatttaggtgacactatagtgtgtcttagcaagccttgcgtttcagagctatgctggaaacagc

SEQ ID NO: 68686 - DNA, 70 bp, Artificial Sequence
  Synthetic
gccaagcatttaggtgacactatagcaacaccagagagttcacatgtttcagagctatgctggaaacagc

SEQ ID NO: 68687 - DNA, 70 bp, Artificial Sequence
  Synthetic
gccaagcatttaggtgacactatagggcccaatggcctgctttaagtttcagagctatgctggaaacagc

SEQ ID NO: 68688 - DNA, 70 bp, Artificial Sequence
  Synthetic
gccaagcatttaggtgacactatagcaagccagctgctcaccccagtttcagagctatgctggaaacagc

SEQ ID NO: 68689 - DNA, 70 bp, Artificial Sequence
  Synthetic
gccaagcatttaggtgacactatagtgtaaggtttctctcctgcagtttcagagctatgctggaaacagc

SEQ ID NO: 68690 - DNA, 70 bp, Artificial Sequence
  Synthetic
gccaagcatttaggtgacactatagaaggtttgaactcctgttgagtttcagagctatgctggaaacagc

SEQ ID NO: 68691 - DNA, 70 bp, Artificial Sequence
  Synthetic
gccaagcatttaggtgacactatagtcaacacttatctaacagcagtttcagagctatgctggaaacagc

SEQ ID NO: 68692 - DNA, 70 bp, Artificial Sequence
  Synthetic
gccaagcatttaggtgacactataggggggggcaagaacggtagtgtttcagagctatgctggaaacagc

SEQ ID NO: 68693 - DNA, 70 bp, Artificial Sequence
  Synthetic
gccaagcatttaggtgacactatagacaggaaggaagtctgtggcgtttcagagctatgctggaaacagc

SEQ ID NO: 68694 - DNA, 70 bp, Artificial Sequence
  Synthetic
gccaagcatttaggtgacactataggccattgaaatctggagtgtgtttcagagctatgctggaaacagc

SEQ ID NO: 68695 - DNA, 70 bp, Artificial Sequence
  Synthetic
gccaagcatttaggtgacactataggaacattctgatgaagtcgagtttcagagctatgctggaaacagc

SEQ ID NO: 68696 - DNA, 70 bp, Artificial Sequence
  Synthetic
gccaagcatttaggtgacactatagactgtgggaagcgctacaaggtttcagagctatgctggaaacagc

SEQ ID NO: 68697 - DNA, 70 bp, Artificial Sequence
  Synthetic
gccaagcatttaggtgacactataggaacatcagagaatccacacgtttcagagctatgctggaaacagc

SEQ ID NO: 68698 - DNA, 70 bp, Artificial Sequence
  Synthetic
gccaagcatttaggtgacactatagtccaagtttaagtttgagccgtttcagagctatgctggaaacagc

SEQ ID NO: 68699 - DNA, 70 bp, Artificial Sequence
  Synthetic
gccaagcatttaggtgacactatagtatcatcagaaagtccatacgtttcagagctatgctggaaacagc

SEQ ID NO: 68700 - DNA, 70 bp, Artificial Sequence
  Synthetic
gccaagcatttaggtgacactatagaaccaccaaagagtgcatttgtttcagagctatgctggaaacagc

SEQ ID NO: 68701 - DNA, 70 bp, Artificial Sequence
  Synthetic
gccaagcatttaggtgacactatagcatcagagtgtccatagtgagtttcagagctatgctggaaacagc

SEQ ID NO: 68702 - DNA, 70 bp, Artificial Sequence
  Synthetic
gccaagcatttaggtgacactatagcgttctccccttcaattcaagtttcagagctatgctggaaacagc

SEQ ID NO: 68703 - DNA, 70 bp, Artificial Sequence
  Synthetic
gccaagcatttaggtgacactatagattcatcagagagtccatgagtttcagagctatgctggaaacagc

SEQ ID NO: 68704 - DNA, 70 bp, Artificial Sequence
  Synthetic
gccaagcatttaggtgacactatagcagagggaggaagttctacagtttcagagctatgctggaaacagc

SEQ ID NO: 68705 - DNA, 70 bp, Artificial Sequence
  Synthetic
gccaagcatttaggtgacactatagatcagagagtccacactggagtttcagagctatgctggaaacagc

SEQ ID NO: 68706 - DNA, 70 bp, Artificial Sequence
  Synthetic
gccaagcatttaggtgacactatagccaactcgcatcagaagacggtttcagagctatgctggaaacagc

SEQ ID NO: 68707 - DNA, 70 bp, Artificial Sequence
  Synthetic
gccaagcatttaggtgacactatagtgggctaatgtcagttagcggtttcagagctatgctggaaacagc

SEQ ID NO: 68708 - DNA, 70 bp, Artificial Sequence
  Synthetic
gccaagcatttaggtgacactatagcctgggagctccattccctagtttcagagctatgctggaaacagc

SEQ ID NO: 68709 - DNA, 70 bp, Artificial Sequence
  Synthetic
gccaagcatttaggtgacactatagcttatgaatgcgttcagtgtgtttcagagctatgctggaaacagc

SEQ ID NO: 68710 - DNA, 70 bp, Artificial Sequence
  Synthetic
gccaagcatttaggtgacactatagacaagaactgctttcttccggtttcagagctatgctggaaacagc

SEQ ID NO: 68711 - DNA, 70 bp, Artificial Sequence
  Synthetic
gccaagcatttaggtgacactatagacatcagagaattcacacaagtttcagagctatgctggaaacagc

SEQ ID NO: 68712 - DNA, 70 bp, Artificial Sequence
  Synthetic
gccaagcatttaggtgacactatagggaatagaagctcccaaaaagtttcagagctatgctggaaacagc

SEQ ID NO: 68713 - DNA, 70 bp, Artificial Sequence
  Synthetic
gccaagcatttaggtgacactatagagaagacacacacaaagaaggtttcagagctatgctggaaacagc

SEQ ID NO: 68714 - DNA, 70 bp, Artificial Sequence
  Synthetic
gccaagcatttaggtgacactatagacaactttctgtgcactttcgtttcagagctatgctggaaacagc

SEQ ID NO: 68715 - DNA, 70 bp, Artificial Sequence
  Synthetic
gccaagcatttaggtgacactatagttagagccatcatttaaagcgtttcagagctatgctggaaacagc

SEQ ID NO: 68716 - DNA, 70 bp, Artificial Sequence
  Synthetic
gccaagcatttaggtgacactatagtgtcacattcttcactatgtgtttcagagctatgctggaaacagc

SEQ ID NO: 68717 - DNA, 70 bp, Artificial Sequence
  Synthetic
gccaagcatttaggtgacactataggagatggtggatgaacccccgtttcagagctatgctggaaacagc

SEQ ID NO: 68718 - DNA, 70 bp, Artificial Sequence
  Synthetic
gccaagcatttaggtgacactataggagttatcttatctgtggtggtttcagagctatgctggaaacagc

SEQ ID NO: 68719 - DNA, 70 bp, Artificial Sequence
  Synthetic
gccaagcatttaggtgacactatagagaacgttcacaagggataagtttcagagctatgctggaaacagc

SEQ ID NO: 68720 - DNA, 70 bp, Artificial Sequence
  Synthetic
gccaagcatttaggtgacactataggttgagaaaggtgtgaagacgtttcagagctatgctggaaacagc

SEQ ID NO: 68721 - DNA, 70 bp, Artificial Sequence
  Synthetic
gccaagcatttaggtgacactatagattcagggcttcgtatacatgtttcagagctatgctggaaacagc

SEQ ID NO: 68722 - DNA, 70 bp, Artificial Sequence
  Synthetic
gccaagcatttaggtgacactatagccttatcagtgtagtgaatggtttcagagctatgctggaaacagc

SEQ ID NO: 68723 - DNA, 70 bp, Artificial Sequence
  Synthetic
gccaagcatttaggtgacactatagagtcatcagagaactcacacgtttcagagctatgctggaaacagc

SEQ ID NO: 68724 - DNA, 70 bp, Artificial Sequence
  Synthetic
gccaagcatttaggtgacactatagtctcacagtgaagacacttggtttcagagctatgctggaaacagc

SEQ ID NO: 68725 - DNA, 70 bp, Artificial Sequence
  Synthetic
gccaagcatttaggtgacactataggatgagagactgtcagcatagtttcagagctatgctggaaacagc

SEQ ID NO: 68726 - DNA, 70 bp, Artificial Sequence
  Synthetic
gccaagcatttaggtgacactataggacttctctgatgtgcaatggtttcagagctatgctggaaacagc

SEQ ID NO: 68727 - DNA, 70 bp, Artificial Sequence
  Synthetic
gccaagcatttaggtgacactataggagctgtgacttccaacaaagtttcagagctatgctggaaacagc

SEQ ID NO: 68728 - DNA, 70 bp, Artificial Sequence
  Synthetic
gccaagcatttaggtgacactatagaaagcactgtcacatcttttgtttcagagctatgctggaaacagc

SEQ ID NO: 68729 - DNA, 70 bp, Artificial Sequence
  Synthetic
gccaagcatttaggtgacactatagcaactggcttgagagctatggtttcagagctatgctggaaacagc

SEQ ID NO: 68730 - DNA, 70 bp, Artificial Sequence
  Synthetic
gccaagcatttaggtgacactatagccggtgcttgatgaggtcaggtttcagagctatgctggaaacagc

SEQ ID NO: 68731 - DNA, 70 bp, Artificial Sequence
  Synthetic
gccaagcatttaggtgacactatagtcctcactgccgtcctcagggtttcagagctatgctggaaacagc

SEQ ID NO: 68732 - DNA, 70 bp, Artificial Sequence
  Synthetic
gccaagcatttaggtgacactatagagtactcttatagtagcaacgtttcagagctatgctggaaacagc

SEQ ID NO: 68733 - DNA, 70 bp, Artificial Sequence
  Synthetic
gccaagcatttaggtgacactatagtaccatcatagacttcataggtttcagagctatgctggaaacagc

SEQ ID NO: 68734 - DNA, 70 bp, Artificial Sequence
  Synthetic
gccaagcatttaggtgacactatagttccagactcccttgcagcagtttcagagctatgctggaaacagc

SEQ ID NO: 68735 - DNA, 70 bp, Artificial Sequence
  Synthetic
gccaagcatttaggtgacactatagactctgaaccatcactccccgtttcagagctatgctggaaacagc

SEQ ID NO: 68736 - DNA, 70 bp, Artificial Sequence
  Synthetic
gccaagcatttaggtgacactatagtcaacttctgaacccactacgtttcagagctatgctggaaacagc

SEQ ID NO: 68737 - DNA, 70 bp, Artificial Sequence
  Synthetic
gccaagcatttaggtgacactatagaaataacttgctggcttgtcgtttcagagctatgctggaaacagc

SEQ ID NO: 68738 - DNA, 70 bp, Artificial Sequence
  Synthetic
gccaagcatttaggtgacactatagagtcatctctgcagcttgatgtttcagagctatgctggaaacagc

SEQ ID NO: 68739 - DNA, 70 bp, Artificial Sequence
  Synthetic
gccaagcatttaggtgacactatagttctttctttttcgtcttccgtttcagagctatgctggaaacagc

SEQ ID NO: 68740 - DNA, 70 bp, Artificial Sequence
  Synthetic
gccaagcatttaggtgacactatagaccagccagagttacaggtagtttcagagctatgctggaaacagc

SEQ ID NO: 68741 - DNA, 70 bp, Artificial Sequence
  Synthetic
gccaagcatttaggtgacactatagccgcctcctgagcgagactagtttcagagctatgctggaaacagc

SEQ ID NO: 68742 - DNA, 70 bp, Artificial Sequence
  Synthetic
gccaagcatttaggtgacactatagctcgcactcagcgcactcgtgtttcagagctatgctggaaacagc

SEQ ID NO: 68743 - DNA, 70 bp, Artificial Sequence
  Synthetic
gccaagcatttaggtgacactatagtgagtaagttgtccacagaagtttcagagctatgctggaaacagc

SEQ ID NO: 68744 - DNA, 70 bp, Artificial Sequence
  Synthetic
gccaagcatttaggtgacactatagactgtgggaagcgctacgaggtttcagagctatgctggaaacagc

SEQ ID NO: 68745 - DNA, 70 bp, Artificial Sequence
  Synthetic
gccaagcatttaggtgacactataggtagtctttgatgagtcagagtttcagagctatgctggaaacagc

SEQ ID NO: 68746 - DNA, 70 bp, Artificial Sequence
  Synthetic
gccaagcatttaggtgacactatagccctttagatgtaatgagtggtttcagagctatgctggaaacagc

SEQ ID NO: 68747 - DNA, 70 bp, Artificial Sequence
  Synthetic
gccaagcatttaggtgacactatagcagcatcaacgtgttcatacgtttcagagctatgctggaaacagc

SEQ ID NO: 68748 - DNA, 70 bp, Artificial Sequence
  Synthetic
gccaagcatttaggtgacactatagataggtaaagccacaggcaggtttcagagctatgctggaaacagc

SEQ ID NO: 68749 - DNA, 70 bp, Artificial Sequence
  Synthetic
gccaagcatttaggtgacactatagttcctgggctcaggcctcgcgtttcagagctatgctggaaacagc

SEQ ID NO: 68750 - DNA, 70 bp, Artificial Sequence
  Synthetic
gccaagcatttaggtgacactatagtcagagaatgcacacagaaggtttcagagctatgctggaaacagc

SEQ ID NO: 68751 - DNA, 70 bp, Artificial Sequence
  Synthetic
gccaagcatttaggtgacactataggcaggcaggaggtcctcagagtttcagagctatgctggaaacagc

SEQ ID NO: 68752 - DNA, 70 bp, Artificial Sequence
  Synthetic
gccaagcatttaggtgacactataggggtgtgtggctctttcacggtttcagagctatgctggaaacagc

SEQ ID NO: 68753 - DNA, 70 bp, Artificial Sequence
  Synthetic
gccaagcatttaggtgacactatagaagggctgaactgtatctaagtttcagagctatgctggaaacagc

SEQ ID NO: 68754 - DNA, 70 bp, Artificial Sequence
  Synthetic
gccaagcatttaggtgacactatagacaccagagaattcacacaggtttcagagctatgctggaaacagc

SEQ ID NO: 68755 - DNA, 70 bp, Artificial Sequence
  Synthetic
gccaagcatttaggtgacactatagtgaatgcaacaaatgtctcagtttcagagctatgctggaaacagc

SEQ ID NO: 68756 - DNA, 70 bp, Artificial Sequence
  Synthetic
gccaagcatttaggtgacactatagagtttaagagatgcagctaagtttcagagctatgctggaaacagc

SEQ ID NO: 68757 - DNA, 70 bp, Artificial Sequence
  Synthetic
gccaagcatttaggtgacactataggaatcgttatactcaggcacgtttcagagctatgctggaaacagc

SEQ ID NO: 68758 - DNA, 70 bp, Artificial Sequence
  Synthetic
gccaagcatttaggtgacactataggtcggccccgggcccctcacgtttcagagctatgctggaaacagc

SEQ ID NO: 68759 - DNA, 70 bp, Artificial Sequence
  Synthetic
gccaagcatttaggtgacactatagtctaaagcaggcgcgctcacgtttcagagctatgctggaaacagc

SEQ ID NO: 68760 - DNA, 70 bp, Artificial Sequence
  Synthetic
gccaagcatttaggtgacactatagtgtgaacactggattctgtggtttcagagctatgctggaaacagc

SEQ ID NO: 68761 - DNA, 70 bp, Artificial Sequence
  Synthetic
gccaagcatttaggtgacactatagcacagccgcagagtcagggcgtttcagagctatgctggaaacagc

SEQ ID NO: 68762 - DNA, 70 bp, Artificial Sequence
  Synthetic
gccaagcatttaggtgacactatagctcttcaggaaagtggtcaagtttcagagctatgctggaaacagc

SEQ ID NO: 68763 - DNA, 70 bp, Artificial Sequence
  Synthetic
gccaagcatttaggtgacactataggaacctggagtctgtgggtggtttcagagctatgctggaaacagc

SEQ ID NO: 68764 - DNA, 70 bp, Artificial Sequence
  Synthetic
gccaagcatttaggtgacactataggtggcaaggtctttagtctggtttcagagctatgctggaaacagc

SEQ ID NO: 68765 - DNA, 70 bp, Artificial Sequence
  Synthetic
gccaagcatttaggtgacactataggcctcacagatgtcttgaccgtttcagagctatgctggaaacagc

SEQ ID NO: 68766 - DNA, 70 bp, Artificial Sequence
  Synthetic
gccaagcatttaggtgacactatagtcgcagccagcggaggtctggtttcagagctatgctggaaacagc

SEQ ID NO: 68767 - DNA, 70 bp, Artificial Sequence
  Synthetic
gccaagcatttaggtgacactatagctgaagccagcgaaggtctggtttcagagctatgctggaaacagc

SEQ ID NO: 68768 - DNA, 70 bp, Artificial Sequence
  Synthetic
gccaagcatttaggtgacactataggtggtggtggtgggggtagcgtttcagagctatgctggaaacagc

SEQ ID NO: 68769 - DNA, 70 bp, Artificial Sequence
  Synthetic
gccaagcatttaggtgacactatagttttcttcaggttgctcaacgtttcagagctatgctggaaacagc

SEQ ID NO: 68770 - DNA, 70 bp, Artificial Sequence
  Synthetic
gccaagcatttaggtgacactatagagcaacccatggaaacataagtttcagagctatgctggaaacagc

SEQ ID NO: 68771 - DNA, 70 bp, Artificial Sequence
  Synthetic
gccaagcatttaggtgacactatagatgaggaacaagagaactaggtttcagagctatgctggaaacagc

SEQ ID NO: 68772 - DNA, 70 bp, Artificial Sequence
  Synthetic
gccaagcatttaggtgacactatagaaaaggctcttcaactgttggtttcagagctatgctggaaacagc

SEQ ID NO: 68773 - DNA, 70 bp, Artificial Sequence
  Synthetic
gccaagcatttaggtgacactatagattcttccaaattagttggggtttcagagctatgctggaaacagc

SEQ ID NO: 68774 - DNA, 70 bp, Artificial Sequence
  Synthetic
gccaagcatttaggtgacactatagccatgtctcatccatactgtgtttcagagctatgctggaaacagc

SEQ ID NO: 68775 - DNA, 70 bp, Artificial Sequence
  Synthetic
gccaagcatttaggtgacactatagttttctcgggcacaattagggtttcagagctatgctggaaacagc

SEQ ID NO: 68776 - DNA, 70 bp, Artificial Sequence
  Synthetic
gccaagcatttaggtgacactatagttgttggaacttattccttggtttcagagctatgctggaaacagc

SEQ ID NO: 68777 - DNA, 70 bp, Artificial Sequence
  Synthetic
gccaagcatttaggtgacactatagggccctcggggctcagtcatgtttcagagctatgctggaaacagc

SEQ ID NO: 68778 - DNA, 70 bp, Artificial Sequence
  Synthetic
gccaagcatttaggtgacactatagttgtacagggagtgtgggtggtttcagagctatgctggaaacagc

SEQ ID NO: 68779 - DNA, 70 bp, Artificial Sequence
  Synthetic
gccaagcatttaggtgacactatagtggatagttactgaacattcgtttcagagctatgctggaaacagc

SEQ ID NO: 68780 - DNA, 70 bp, Artificial Sequence
  Synthetic
gccaagcatttaggtgacactataggtacatcagagaacacacatgtttcagagctatgctggaaacagc

SEQ ID NO: 68781 - DNA, 70 bp, Artificial Sequence
  Synthetic
gccaagcatttaggtgacactataggacaccgcgccactgttacagtttcagagctatgctggaaacagc

SEQ ID NO: 68782 - DNA, 70 bp, Artificial Sequence
  Synthetic
gccaagcatttaggtgacactataggacacctcaggtccgtcactgtttcagagctatgctggaaacagc

SEQ ID NO: 68783 - DNA, 70 bp, Artificial Sequence
  Synthetic
gccaagcatttaggtgacactatagtttcactatgttggccaggagtttcagagctatgctggaaacagc

SEQ ID NO: 68784 - DNA, 70 bp, Artificial Sequence
  Synthetic
gccaagcatttaggtgacactatagacaccagaggacacactgacgtttcagagctatgctggaaacagc

SEQ ID NO: 68785 - DNA, 70 bp, Artificial Sequence
  Synthetic
gccaagcatttaggtgacactatagtggtaagaaactctgcgaatgtttcagagctatgctggaaacagc

SEQ ID NO: 68786 - DNA, 70 bp, Artificial Sequence
  Synthetic
gccaagcatttaggtgacactatagcaaccaccttggaagactaggtttcagagctatgctggaaacagc

SEQ ID NO: 68787 - DNA, 70 bp, Artificial Sequence
  Synthetic
gccaagcatttaggtgacactatagctgcctctgcacaaatgtgagtttcagagctatgctggaaacagc

SEQ ID NO: 68788 - DNA, 70 bp, Artificial Sequence
  Synthetic
gccaagcatttaggtgacactataggcagcaggagtgaattagccgtttcagagctatgctggaaacagc

SEQ ID NO: 68789 - DNA, 70 bp, Artificial Sequence
  Synthetic
gccaagcatttaggtgacactatagtcagaaagactcaaccacctgtttcagagctatgctggaaacagc

SEQ ID NO: 68790 - DNA, 70 bp, Artificial Sequence
  Synthetic
gccaagcatttaggtgacactatagagccatcacagaattcataggtttcagagctatgctggaaacagc

SEQ ID NO: 68791 - DNA, 70 bp, Artificial Sequence
  Synthetic
gccaagcatttaggtgacactatagattcaacaagatgggttctagtttcagagctatgctggaaacagc

SEQ ID NO: 68792 - DNA, 70 bp, Artificial Sequence
  Synthetic
gccaagcatttaggtgacactatagaagacataattgatcacggagtttcagagctatgctggaaacagc

SEQ ID NO: 68793 - DNA, 70 bp, Artificial Sequence
  Synthetic
gccaagcatttaggtgacactataggattagtaagggatgacctagtttcagagctatgctggaaacagc

SEQ ID NO: 68794 - DNA, 70 bp, Artificial Sequence
  Synthetic
gccaagcatttaggtgacactatagaggctttcacacatgcaaatgtttcagagctatgctggaaacagc

SEQ ID NO: 68795 - DNA, 70 bp, Artificial Sequence
  Synthetic
gccaagcatttaggtgacactatagagagatgaactaaacctcatgtttcagagctatgctggaaacagc

SEQ ID NO: 68796 - DNA, 70 bp, Artificial Sequence
  Synthetic
gccaagcatttaggtgacactatagtgctggggcctgatggctgagtttcagagctatgctggaaacagc

SEQ ID NO: 68797 - DNA, 70 bp, Artificial Sequence
  Synthetic
gccaagcatttaggtgacactatagcagatgagagagattcgcacgtttcagagctatgctggaaacagc

SEQ ID NO: 68798 - DNA, 70 bp, Artificial Sequence
  Synthetic
gccaagcatttaggtgacactatagatgatgttcacaatggctgtgtttcagagctatgctggaaacagc

SEQ ID NO: 68799 - DNA, 70 bp, Artificial Sequence
  Synthetic
gccaagcatttaggtgacactatagccaaaatgacctggaattgggtttcagagctatgctggaaacagc

SEQ ID NO: 68800 - DNA, 70 bp, Artificial Sequence
  Synthetic
gccaagcatttaggtgacactatagtatttctgttagctgcttgagtttcagagctatgctggaaacagc

SEQ ID NO: 68801 - DNA, 70 bp, Artificial Sequence
  Synthetic
gccaagcatttaggtgacactatagagtgcttttaggtatctaaggtttcagagctatgctggaaacagc

SEQ ID NO: 68802 - DNA, 70 bp, Artificial Sequence
  Synthetic
gccaagcatttaggtgacactataggcgccactccgacagtagctgtttcagagctatgctggaaacagc

SEQ ID NO: 68803 - DNA, 70 bp, Artificial Sequence
  Synthetic
gccaagcatttaggtgacactatagcgtcaacatgttacttccaagtttcagagctatgctggaaacagc

SEQ ID NO: 68804 - DNA, 70 bp, Artificial Sequence
  Synthetic
gccaagcatttaggtgacactataggaagcaaatatggcttggtggtttcagagctatgctggaaacagc

SEQ ID NO: 68805 - DNA, 70 bp, Artificial Sequence
  Synthetic
gccaagcatttaggtgacactatagtaaacgagggaaattactctgtttcagagctatgctggaaacagc

SEQ ID NO: 68806 - DNA, 70 bp, Artificial Sequence
  Synthetic
gccaagcatttaggtgacactatagtttccaagccagagtcatctgtttcagagctatgctggaaacagc

SEQ ID NO: 68807 - DNA, 70 bp, Artificial Sequence
  Synthetic
gccaagcatttaggtgacactatagcattacttactgaattcccggtttcagagctatgctggaaacagc

SEQ ID NO: 68808 - DNA, 70 bp, Artificial Sequence
  Synthetic
gccaagcatttaggtgacactatagtcggatctcattcgtcatcagtttcagagctatgctggaaacagc

SEQ ID NO: 68809 - DNA, 70 bp, Artificial Sequence
  Synthetic
gccaagcatttaggtgacactatagcagcacggatctctaagagcgtttcagagctatgctggaaacagc

SEQ ID NO: 68810 - DNA, 70 bp, Artificial Sequence
  Synthetic
gccaagcatttaggtgacactataggttcagggttgaggtcagtagtttcagagctatgctggaaacagc

SEQ ID NO: 68811 - DNA, 70 bp, Artificial Sequence
  Synthetic
gccaagcatttaggtgacactatagggggtttgcagacgttagtagtttcagagctatgctggaaacagc

SEQ ID NO: 68812 - DNA, 70 bp, Artificial Sequence
  Synthetic
gccaagcatttaggtgacactatagcctccccatgagggctaatagtttcagagctatgctggaaacagc

SEQ ID NO: 68813 - DNA, 70 bp, Artificial Sequence
  Synthetic
gccaagcatttaggtgacactatagtagtaaggagcaaacagcacgtttcagagctatgctggaaacagc

SEQ ID NO: 68814 - DNA, 70 bp, Artificial Sequence
  Synthetic
gccaagcatttaggtgacactatagcagagttgaactctgacagagtttcagagctatgctggaaacagc

SEQ ID NO: 68815 - DNA, 70 bp, Artificial Sequence
  Synthetic
gccaagcatttaggtgacactatagactcggcggaactgtgctccgtttcagagctatgctggaaacagc

SEQ ID NO: 68816 - DNA, 70 bp, Artificial Sequence
  Synthetic
gccaagcatttaggtgacactataggtgctgtcggctgggcgtgggtttcagagctatgctggaaacagc

SEQ ID NO: 68817 - DNA, 70 bp, Artificial Sequence
  Synthetic
gccaagcatttaggtgacactataggaaggcctgccagcgctttcgtttcagagctatgctggaaacagc

SEQ ID NO: 68818 - DNA, 70 bp, Artificial Sequence
  Synthetic
gccaagcatttaggtgacactatagaagatttgagctctgactaagtttcagagctatgctggaaacagc

SEQ ID NO: 68819 - DNA, 70 bp, Artificial Sequence
  Synthetic
gccaagcatttaggtgacactatagtaaatcagctgagatgtgtggtttcagagctatgctggaaacagc

SEQ ID NO: 68820 - DNA, 70 bp, Artificial Sequence
  Synthetic
gccaagcatttaggtgacactatagtgccccaggtcactttcagggtttcagagctatgctggaaacagc

SEQ ID NO: 68821 - DNA, 70 bp, Artificial Sequence
  Synthetic
gccaagcatttaggtgacactatagcacatttttagatggcaggagtttcagagctatgctggaaacagc

SEQ ID NO: 68822 - DNA, 70 bp, Artificial Sequence
  Synthetic
gccaagcatttaggtgacactatagttatagtgtggactctttgagtttcagagctatgctggaaacagc

SEQ ID NO: 68823 - DNA, 70 bp, Artificial Sequence
  Synthetic
gccaagcatttaggtgacactatagtatggggaagggagtggagggtttcagagctatgctggaaacagc

SEQ ID NO: 68824 - DNA, 70 bp, Artificial Sequence
  Synthetic
gccaagcatttaggtgacactatagacattaagagtctctcaccagtttcagagctatgctggaaacagc

SEQ ID NO: 68825 - DNA, 70 bp, Artificial Sequence
  Synthetic
gccaagcatttaggtgacactatagaaaagtgctcacaaagacttgtttcagagctatgctggaaacagc

SEQ ID NO: 68826 - DNA, 70 bp, Artificial Sequence
  Synthetic
gccaagcatttaggtgacactataggccgcgcgtctcatgcttccgtttcagagctatgctggaaacagc

SEQ ID NO: 68827 - DNA, 70 bp, Artificial Sequence
  Synthetic
gccaagcatttaggtgacactataggcttacctgcatgctggtaagtttcagagctatgctggaaacagc

SEQ ID NO: 68828 - DNA, 70 bp, Artificial Sequence
  Synthetic
gccaagcatttaggtgacactataggaggtggtggaggtggagatgtttcagagctatgctggaaacagc

SEQ ID NO: 68829 - DNA, 70 bp, Artificial Sequence
  Synthetic
gccaagcatttaggtgacactataggtgaagactttctcagtcacgtttcagagctatgctggaaacagc

SEQ ID NO: 68830 - DNA, 70 bp, Artificial Sequence
  Synthetic
gccaagcatttaggtgacactatagctctacctcccgaattcaaggtttcagagctatgctggaaacagc

SEQ ID NO: 68831 - DNA, 70 bp, Artificial Sequence
  Synthetic
gccaagcatttaggtgacactatagtggtgaccatgcagtcaggggtttcagagctatgctggaaacagc

SEQ ID NO: 68832 - DNA, 70 bp, Artificial Sequence
  Synthetic
gccaagcatttaggtgacactatagtgtagtagcagctactcagggtttcagagctatgctggaaacagc

SEQ ID NO: 68833 - DNA, 70 bp, Artificial Sequence
  Synthetic
gccaagcatttaggtgacactatagacgcgccctcaggtgcgtgcgtttcagagctatgctggaaacagc

SEQ ID NO: 68834 - DNA, 70 bp, Artificial Sequence
  Synthetic
gccaagcatttaggtgacactatagattcagagctgcgagaacacgtttcagagctatgctggaaacagc

SEQ ID NO: 68835 - DNA, 70 bp, Artificial Sequence
  Synthetic
gccaagcatttaggtgacactatagatttgatgtctgaagaggttgtttcagagctatgctggaaacagc

SEQ ID NO: 68836 - DNA, 70 bp, Artificial Sequence
  Synthetic
gccaagcatttaggtgacactatagaatgttagatcttgggctgtgtttcagagctatgctggaaacagc

SEQ ID NO: 68837 - DNA, 70 bp, Artificial Sequence
  Synthetic
gccaagcatttaggtgacactatagccatattcactgcactcatagtttcagagctatgctggaaacagc

SEQ ID NO: 68838 - DNA, 70 bp, Artificial Sequence
  Synthetic
gccaagcatttaggtgacactatagtgtgaactctctgatgtcgagtttcagagctatgctggaaacagc

SEQ ID NO: 68839 - DNA, 70 bp, Artificial Sequence
  Synthetic
gccaagcatttaggtgacactatagcatctaaatatgcacactgggtttcagagctatgctggaaacagc

SEQ ID NO: 68840 - DNA, 70 bp, Artificial Sequence
  Synthetic
gccaagcatttaggtgacactatagggagctccgttactctcatggtttcagagctatgctggaaacagc

SEQ ID NO: 68841 - DNA, 70 bp, Artificial Sequence
  Synthetic
gccaagcatttaggtgacactatagtcatggagcagaaatacagagtttcagagctatgctggaaacagc

SEQ ID NO: 68842 - DNA, 70 bp, Artificial Sequence
  Synthetic
gccaagcatttaggtgacactatagtgtgggattgactttagtcagtttcagagctatgctggaaacagc

SEQ ID NO: 68843 - DNA, 70 bp, Artificial Sequence
  Synthetic
gccaagcatttaggtgacactatagtgagccagcacgcacagtgagtttcagagctatgctggaaacagc

SEQ ID NO: 68844 - DNA, 70 bp, Artificial Sequence
  Synthetic
gccaagcatttaggtgacactatagtgctgcatggcctgacctaggtttcagagctatgctggaaacagc

SEQ ID NO: 68845 - DNA, 70 bp, Artificial Sequence
  Synthetic
gccaagcatttaggtgacactataggttcatgtcttcgaagtgaagtttcagagctatgctggaaacagc

SEQ ID NO: 68846 - DNA, 70 bp, Artificial Sequence
  Synthetic
gccaagcatttaggtgacactataggcatgcccggggtgaggtgtgtttcagagctatgctggaaacagc

SEQ ID NO: 68847 - DNA, 70 bp, Artificial Sequence
  Synthetic
gccaagcatttaggtgacactatagacctctgcctcccaaagtgcgtttcagagctatgctggaaacagc

SEQ ID NO: 68848 - DNA, 70 bp, Artificial Sequence
  Synthetic
gccaagcatttaggtgacactatagaaaatcactgtcacatcttcgtttcagagctatgctggaaacagc

SEQ ID NO: 68849 - DNA, 70 bp, Artificial Sequence
  Synthetic
gccaagcatttaggtgacactataggccacaatcttcacatttgtgtttcagagctatgctggaaacagc

SEQ ID NO: 68850 - DNA, 70 bp, Artificial Sequence
  Synthetic
gccaagcatttaggtgacactatagaagagttgaggactgcttaagtttcagagctatgctggaaacagc

SEQ ID NO: 68851 - DNA, 70 bp, Artificial Sequence
  Synthetic
gccaagcatttaggtgacactataggtacatcagcgaactcataagtttcagagctatgctggaaacagc

SEQ ID NO: 68852 - DNA, 70 bp, Artificial Sequence
  Synthetic
gccaagcatttaggtgacactatagctcctaaagcctggggttatgtttcagagctatgctggaaacagc

SEQ ID NO: 68853 - DNA, 70 bp, Artificial Sequence
  Synthetic
gccaagcatttaggtgacactatagaatgtgagaagagtttcagcgtttcagagctatgctggaaacagc

SEQ ID NO: 68854 - DNA, 70 bp, Artificial Sequence
  Synthetic
gccaagcatttaggtgacactataggtctcatttctcagcttcacgtttcagagctatgctggaaacagc

SEQ ID NO: 68855 - DNA, 70 bp, Artificial Sequence
  Synthetic
gccaagcatttaggtgacactatagaaacacataagaatgcactcgtttcagagctatgctggaaacagc

SEQ ID NO: 68856 - DNA, 70 bp, Artificial Sequence
  Synthetic
gccaagcatttaggtgacactatagacataaaaggacacactggagtttcagagctatgctggaaacagc

SEQ ID NO: 68857 - DNA, 70 bp, Artificial Sequence
  Synthetic
gccaagcatttaggtgacactatagagaaccttcgaattcatgaagtttcagagctatgctggaaacagc

SEQ ID NO: 68858 - DNA, 70 bp, Artificial Sequence
  Synthetic
gccaagcatttaggtgacactatagtatagggtttctccatactggtttcagagctatgctggaaacagc

SEQ ID NO: 68859 - DNA, 70 bp, Artificial Sequence
  Synthetic
gccaagcatttaggtgacactatagagagaacccatatgaatgtagtttcagagctatgctggaaacagc

SEQ ID NO: 68860 - DNA, 70 bp, Artificial Sequence
  Synthetic
gccaagcatttaggtgacactataggccgggaggcggctaacccagtttcagagctatgctggaaacagc

SEQ ID NO: 68861 - DNA, 70 bp, Artificial Sequence
  Synthetic
gccaagcatttaggtgacactatagaaccatattagagattagccgtttcagagctatgctggaaacagc

SEQ ID NO: 68862 - DNA, 70 bp, Artificial Sequence
  Synthetic
gccaagcatttaggtgacactataggtcgaagctgtcgtcttgcggtttcagagctatgctggaaacagc

SEQ ID NO: 68863 - DNA, 70 bp, Artificial Sequence
  Synthetic
gccaagcatttaggtgacactatagctggctgctcatggaacctcgtttcagagctatgctggaaacagc

SEQ ID NO: 68864 - DNA, 70 bp, Artificial Sequence
  Synthetic
gccaagcatttaggtgacactatagcaccaggtcactcactttaggtttcagagctatgctggaaacagc

SEQ ID NO: 68865 - DNA, 70 bp, Artificial Sequence
  Synthetic
gccaagcatttaggtgacactatagcttcatcagaggattcacacgtttcagagctatgctggaaacagc

SEQ ID NO: 68866 - DNA, 70 bp, Artificial Sequence
  Synthetic
gccaagcatttaggtgacactataggagactctccagaacgccatgtttcagagctatgctggaaacagc

SEQ ID NO: 68867 - DNA, 70 bp, Artificial Sequence
  Synthetic
gccaagcatttaggtgacactatagagctattagaagaagtcttggtttcagagctatgctggaaacagc

SEQ ID NO: 68868 - DNA, 70 bp, Artificial Sequence
  Synthetic
gccaagcatttaggtgacactataggccgaggtgggcggatcacggtttcagagctatgctggaaacagc

SEQ ID NO: 68869 - DNA, 70 bp, Artificial Sequence
  Synthetic
gccaagcatttaggtgacactatagcagcatcagagacatcatatgtttcagagctatgctggaaacagc

SEQ ID NO: 68870 - DNA, 70 bp, Artificial Sequence
  Synthetic
gccaagcatttaggtgacactatagtctttccacatctgttacaagtttcagagctatgctggaaacagc

SEQ ID NO: 68871 - DNA, 70 bp, Artificial Sequence
  Synthetic
gccaagcatttaggtgacactatagttcatgatgctagactaggagtttcagagctatgctggaaacagc

SEQ ID NO: 68872 - DNA, 70 bp, Artificial Sequence
  Synthetic
gccaagcatttaggtgacactatagaccaaacgctcattctttttgtttcagagctatgctggaaacagc

SEQ ID NO: 68873 - DNA, 70 bp, Artificial Sequence
  Synthetic
gccaagcatttaggtgacactatagaactaggctcagaagaagaggtttcagagctatgctggaaacagc

SEQ ID NO: 68874 - DNA, 70 bp, Artificial Sequence
  Synthetic
gccaagcatttaggtgacactatagtctggggctgctaaatgaatgtttcagagctatgctggaaacagc

SEQ ID NO: 68875 - DNA, 70 bp, Artificial Sequence
  Synthetic
gccaagcatttaggtgacactatagtaccatcataggcttcataggtttcagagctatgctggaaacagc

SEQ ID NO: 68876 - DNA, 70 bp, Artificial Sequence
  Synthetic
gccaagcatttaggtgacactatagtcttgctcctagaaattactgtttcagagctatgctggaaacagc

SEQ ID NO: 68877 - DNA, 70 bp, Artificial Sequence
  Synthetic
gccaagcatttaggtgacactatagattgaatctataggacttgggtttcagagctatgctggaaacagc

SEQ ID NO: 68878 - DNA, 70 bp, Artificial Sequence
  Synthetic
gccaagcatttaggtgacactatagtgtcatcaaagaagtcatacgtttcagagctatgctggaaacagc

SEQ ID NO: 68879 - DNA, 70 bp, Artificial Sequence
  Synthetic
gccaagcatttaggtgacactatagtgctgccacccaatggctacgtttcagagctatgctggaaacagc

SEQ ID NO: 68880 - DNA, 70 bp, Artificial Sequence
  Synthetic
gccaagcatttaggtgacactataggttttctcttgttcccctacgtttcagagctatgctggaaacagc

SEQ ID NO: 68881 - DNA, 70 bp, Artificial Sequence
  Synthetic
gccaagcatttaggtgacactatagaatgtgagcaagcttttaaggtttcagagctatgctggaaacagc

SEQ ID NO: 68882 - DNA, 70 bp, Artificial Sequence
  Synthetic
gccaagcatttaggtgacactataggcaacaggactggaatgacggtttcagagctatgctggaaacagc

SEQ ID NO: 68883 - DNA, 70 bp, Artificial Sequence
  Synthetic
gccaagcatttaggtgacactatagtttcatacctagcacaacatgtttcagagctatgctggaaacagc

SEQ ID NO: 68884 - DNA, 70 bp, Artificial Sequence
  Synthetic
gccaagcatttaggtgacactatagaaagatgcagatgttctctggtttcagagctatgctggaaacagc

SEQ ID NO: 68885 - DNA, 70 bp, Artificial Sequence
  Synthetic
gccaagcatttaggtgacactatagtcaggcctcattagacatcggtttcagagctatgctggaaacagc

SEQ ID NO: 68886 - DNA, 70 bp, Artificial Sequence
  Synthetic
gccaagcatttaggtgacactatagagatagaagaaagttggcctgtttcagagctatgctggaaacagc

SEQ ID NO: 68887 - DNA, 70 bp, Artificial Sequence
  Synthetic
gccaagcatttaggtgacactataggccatgaaatgtagttagtggtttcagagctatgctggaaacagc

SEQ ID NO: 68888 - DNA, 70 bp, Artificial Sequence
  Synthetic
gccaagcatttaggtgacactatagataatcctttgtcacgttctgtttcagagctatgctggaaacagc

SEQ ID NO: 68889 - DNA, 70 bp, Artificial Sequence
  Synthetic
gccaagcatttaggtgacactatagcatgacttctcacagctagcgtttcagagctatgctggaaacagc

SEQ ID NO: 68890 - DNA, 70 bp, Artificial Sequence
  Synthetic
gccaagcatttaggtgacactatagagtctttgcacgtgcacgaagtttcagagctatgctggaaacagc

SEQ ID NO: 68891 - DNA, 70 bp, Artificial Sequence
  Synthetic
gccaagcatttaggtgacactatagttcatgttttcgacagtaacgtttcagagctatgctggaaacagc

SEQ ID NO: 68892 - DNA, 70 bp, Artificial Sequence
  Synthetic
gccaagcatttaggtgacactataggtttagaaagagttgaggacgtttcagagctatgctggaaacagc

SEQ ID NO: 68893 - DNA, 70 bp, Artificial Sequence
  Synthetic
gccaagcatttaggtgacactatagagagaccatcctggctaaaagtttcagagctatgctggaaacagc

SEQ ID NO: 68894 - DNA, 70 bp, Artificial Sequence
  Synthetic
gccaagcatttaggtgacactatagcatgtggcaaagcttttagggtttcagagctatgctggaaacagc

SEQ ID NO: 68895 - DNA, 70 bp, Artificial Sequence
  Synthetic
gccaagcatttaggtgacactatagcccaggcggagaggctcagtgtttcagagctatgctggaaacagc

SEQ ID NO: 68896 - DNA, 70 bp, Artificial Sequence
  Synthetic
gccaagcatttaggtgacactataggtgtagactctgagtcgtctgtttcagagctatgctggaaacagc

SEQ ID NO: 68897 - DNA, 70 bp, Artificial Sequence
  Synthetic
gccaagcatttaggtgacactatagcctcgggtcagggcgcagcggtttcagagctatgctggaaacagc

SEQ ID NO: 68898 - DNA, 70 bp, Artificial Sequence
  Synthetic
gccaagcatttaggtgacactatagcaggcctggtgatcaggcttgtttcagagctatgctggaaacagc

SEQ ID NO: 68899 - DNA, 70 bp, Artificial Sequence
  Synthetic
gccaagcatttaggtgacactataggcccaccgccggacgcacacgtttcagagctatgctggaaacagc

SEQ ID NO: 68900 - DNA, 70 bp, Artificial Sequence
  Synthetic
gccaagcatttaggtgacactatagcgacatcagaggcttcatgcgtttcagagctatgctggaaacagc

SEQ ID NO: 68901 - DNA, 70 bp, Artificial Sequence
  Synthetic
gccaagcatttaggtgacactatagagacatcagaaacttcacaggtttcagagctatgctggaaacagc

SEQ ID NO: 68902 - DNA, 70 bp, Artificial Sequence
  Synthetic
gccaagcatttaggtgacactatagcggcgctggggtatcagtgagtttcagagctatgctggaaacagc

SEQ ID NO: 68903 - DNA, 70 bp, Artificial Sequence
  Synthetic
gccaagcatttaggtgacactatagaccctgcatagtgaagaatggtttcagagctatgctggaaacagc

SEQ ID NO: 68904 - DNA, 70 bp, Artificial Sequence
  Synthetic
gccaagcatttaggtgacactatagagctctaaacacaaattagggtttcagagctatgctggaaacagc

SEQ ID NO: 68905 - DNA, 70 bp, Artificial Sequence
  Synthetic
gccaagcatttaggtgacactatagaccagaaaattcagggagaggtttcagagctatgctggaaacagc

SEQ ID NO: 68906 - DNA, 70 bp, Artificial Sequence
  Synthetic
gccaagcatttaggtgacactatagctgagtctatcagcattgttgtttcagagctatgctggaaacagc

SEQ ID NO: 68907 - DNA, 70 bp, Artificial Sequence
  Synthetic
gccaagcatttaggtgacactatagtcataaacgaggaaggaaatgtttcagagctatgctggaaacagc

SEQ ID NO: 68908 - DNA, 70 bp, Artificial Sequence
  Synthetic
gccaagcatttaggtgacactatagacgcaccatgctcacttttcgtttcagagctatgctggaaacagc

SEQ ID NO: 68909 - DNA, 70 bp, Artificial Sequence
  Synthetic
gccaagcatttaggtgacactatagtagttcaggatgagtctgtggtttcagagctatgctggaaacagc

SEQ ID NO: 68910 - DNA, 70 bp, Artificial Sequence
  Synthetic
gccaagcatttaggtgacactatagaaacatcagagaagtcatgcgtttcagagctatgctggaaacagc

SEQ ID NO: 68911 - DNA, 70 bp, Artificial Sequence
  Synthetic
gccaagcatttaggtgacactatagctctgagaaagggaacctaagtttcagagctatgctggaaacagc

SEQ ID NO: 68912 - DNA, 70 bp, Artificial Sequence
  Synthetic
gccaagcatttaggtgacactatagccgtcatcaggaagcccaacgtttcagagctatgctggaaacagc

SEQ ID NO: 68913 - DNA, 70 bp, Artificial Sequence
  Synthetic
gccaagcatttaggtgacactatagtaatggaagctactcgggatgtttcagagctatgctggaaacagc

SEQ ID NO: 68914 - DNA, 70 bp, Artificial Sequence
  Synthetic
gccaagcatttaggtgacactatagactgtttacttatttgccctgtttcagagctatgctggaaacagc

SEQ ID NO: 68915 - DNA, 70 bp, Artificial Sequence
  Synthetic
gccaagcatttaggtgacactatagacacttgcagggtttctaccgtttcagagctatgctggaaacagc

SEQ ID NO: 68916 - DNA, 70 bp, Artificial Sequence
  Synthetic
gccaagcatttaggtgacactatagacttgcactaactgctgtgtgtttcagagctatgctggaaacagc

SEQ ID NO: 68917 - DNA, 70 bp, Artificial Sequence
  Synthetic
gccaagcatttaggtgacactataggccgggggtgtgggtcaggcgtttcagagctatgctggaaacagc

SEQ ID NO: 68918 - DNA, 70 bp, Artificial Sequence
  Synthetic
gccaagcatttaggtgacactatagcaagtgtggagaatgtgacagtttcagagctatgctggaaacagc

SEQ ID NO: 68919 - DNA, 70 bp, Artificial Sequence
  Synthetic
gccaagcatttaggtgacactatagttttcagctgcgtcacacgagtttcagagctatgctggaaacagc

SEQ ID NO: 68920 - DNA, 70 bp, Artificial Sequence
  Synthetic
gccaagcatttaggtgacactataggaattctctgatgtcgtctagtttcagagctatgctggaaacagc

SEQ ID NO: 68921 - DNA, 70 bp, Artificial Sequence
  Synthetic
gccaagcatttaggtgacactataggaactctctgatgctgtgcagtttcagagctatgctggaaacagc

SEQ ID NO: 68922 - DNA, 70 bp, Artificial Sequence
  Synthetic
gccaagcatttaggtgacactatagtgccaaccgaaaatttacacgtttcagagctatgctggaaacagc

SEQ ID NO: 68923 - DNA, 70 bp, Artificial Sequence
  Synthetic
gccaagcatttaggtgacactataggaactcttctgtgtcttaaggtttcagagctatgctggaaacagc

SEQ ID NO: 68924 - DNA, 70 bp, Artificial Sequence
  Synthetic
gccaagcatttaggtgacactataggagcatctgtggctatttctgtttcagagctatgctggaaacagc

SEQ ID NO: 68925 - DNA, 70 bp, Artificial Sequence
  Synthetic
gccaagcatttaggtgacactatagactgcaatgttgtactaggagtttcagagctatgctggaaacagc

SEQ ID NO: 68926 - DNA, 70 bp, Artificial Sequence
  Synthetic
gccaagcatttaggtgacactatagcggcgggtgtcttagctccggtttcagagctatgctggaaacagc

SEQ ID NO: 68927 - DNA, 70 bp, Artificial Sequence
  Synthetic
gccaagcatttaggtgacactatagatcaagaggccagacttgtggtttcagagctatgctggaaacagc

SEQ ID NO: 68928 - DNA, 70 bp, Artificial Sequence
  Synthetic
gccaagcatttaggtgacactataggcaagtagcacagcaaattcgtttcagagctatgctggaaacagc

SEQ ID NO: 68929 - DNA, 70 bp, Artificial Sequence
  Synthetic
gccaagcatttaggtgacactatagtgagtgtaaggtatgtagaagtttcagagctatgctggaaacagc

SEQ ID NO: 68930 - DNA, 70 bp, Artificial Sequence
  Synthetic
gccaagcatttaggtgacactataggccacgggagtcaccactgcgtttcagagctatgctggaaacagc

SEQ ID NO: 68931 - DNA, 70 bp, Artificial Sequence
  Synthetic
gccaagcatttaggtgacactatagtgaagaaaatctgtggtgaagtttcagagctatgctggaaacagc

SEQ ID NO: 68932 - DNA, 70 bp, Artificial Sequence
  Synthetic
gccaagcatttaggtgacactatagacaggcatgtccaccatgccgtttcagagctatgctggaaacagc

SEQ ID NO: 68933 - DNA, 70 bp, Artificial Sequence
  Synthetic
gccaagcatttaggtgacactatagacatactggagagaaaccttgtttcagagctatgctggaaacagc

SEQ ID NO: 68934 - DNA, 70 bp, Artificial Sequence
  Synthetic
gccaagcatttaggtgacactatagagagcgaaactccgtctcgggtttcagagctatgctggaaacagc

SEQ ID NO: 68935 - DNA, 70 bp, Artificial Sequence
  Synthetic
gccaagcatttaggtgacactatagcacactctctcagatccttcgtttcagagctatgctggaaacagc

SEQ ID NO: 68936 - DNA, 70 bp, Artificial Sequence
  Synthetic
gccaagcatttaggtgacactataggctgaggggggcgcatcatggtttcagagctatgctggaaacagc

SEQ ID NO: 68937 - DNA, 70 bp, Artificial Sequence
  Synthetic
gccaagcatttaggtgacactatagcgacatcacagaattcatacgtttcagagctatgctggaaacagc

SEQ ID NO: 68938 - DNA, 70 bp, Artificial Sequence
  Synthetic
gccaagcatttaggtgacactatagcagaaagtccacactggatagtttcagagctatgctggaaacagc

SEQ ID NO: 68939 - DNA, 70 bp, Artificial Sequence
  Synthetic
gccaagcatttaggtgacactatagtctctgatgtttaatgaggtgtttcagagctatgctggaaacagc

SEQ ID NO: 68940 - DNA, 70 bp, Artificial Sequence
  Synthetic
gccaagcatttaggtgacactatagttcccttgtcaggcaccagagtttcagagctatgctggaaacagc

SEQ ID NO: 68941 - DNA, 70 bp, Artificial Sequence
  Synthetic
gccaagcatttaggtgacactatagcaatagggttctctcatgtagtttcagagctatgctggaaacagc

SEQ ID NO: 68942 - DNA, 70 bp, Artificial Sequence
  Synthetic
gccaagcatttaggtgacactatagtagggatgaggaagggctttgtttcagagctatgctggaaacagc

SEQ ID NO: 68943 - DNA, 70 bp, Artificial Sequence
  Synthetic
gccaagcatttaggtgacactatagggagagttcacactgaagaagtttcagagctatgctggaaacagc

SEQ ID NO: 68944 - DNA, 70 bp, Artificial Sequence
  Synthetic
gccaagcatttaggtgacactatagtcagagagttcacaaaagaagtttcagagctatgctggaaacagc

SEQ ID NO: 68945 - DNA, 70 bp, Artificial Sequence
  Synthetic
gccaagcatttaggtgacactatagtaccagaacagacatcttatgtttcagagctatgctggaaacagc

SEQ ID NO: 68946 - DNA, 70 bp, Artificial Sequence
  Synthetic
gccaagcatttaggtgacactatagtcaggataaggaactcataagtttcagagctatgctggaaacagc

SEQ ID NO: 68947 - DNA, 70 bp, Artificial Sequence
  Synthetic
gccaagcatttaggtgacactatagtcctgtacatctaagtaatggtttcagagctatgctggaaacagc

SEQ ID NO: 68948 - DNA, 70 bp, Artificial Sequence
  Synthetic
gccaagcatttaggtgacactatagtgcatacgagaatgcataatgtttcagagctatgctggaaacagc

SEQ ID NO: 68949 - DNA, 70 bp, Artificial Sequence
  Synthetic
gccaagcatttaggtgacactatagtctcttgtgcacagaaagatgtttcagagctatgctggaaacagc

SEQ ID NO: 68950 - DNA, 70 bp, Artificial Sequence
  Synthetic
gccaagcatttaggtgacactatagcacacattcagtaaggcatggtttcagagctatgctggaaacagc

SEQ ID NO: 68951 - DNA, 70 bp, Artificial Sequence
  Synthetic
gccaagcatttaggtgacactatagtccctgagtcatttcattcagtttcagagctatgctggaaacagc

SEQ ID NO: 68952 - DNA, 70 bp, Artificial Sequence
  Synthetic
gccaagcatttaggtgacactatagacgagctgagaaagaagcaagtttcagagctatgctggaaacagc

SEQ ID NO: 68953 - DNA, 70 bp, Artificial Sequence
  Synthetic
gccaagcatttaggtgacactatagatggcaaccgatgggctaaagtttcagagctatgctggaaacagc

SEQ ID NO: 68954 - DNA, 70 bp, Artificial Sequence
  Synthetic
gccaagcatttaggtgacactatagtgaaaactcacagtggagaagtttcagagctatgctggaaacagc

SEQ ID NO: 68955 - DNA, 70 bp, Artificial Sequence
  Synthetic
gccaagcatttaggtgacactatagaaagacatgaaaagactcacgtttcagagctatgctggaaacagc

SEQ ID NO: 68956 - DNA, 70 bp, Artificial Sequence
  Synthetic
gccaagcatttaggtgacactatagcctccactattcattttcacgtttcagagctatgctggaaacagc

SEQ ID NO: 68957 - DNA, 70 bp, Artificial Sequence
  Synthetic
gccaagcatttaggtgacactatagtgtgggcaggcatttattctgtttcagagctatgctggaaacagc

SEQ ID NO: 68958 - DNA, 70 bp, Artificial Sequence
  Synthetic
gccaagcatttaggtgacactatagccctatgaatatagggaatggtttcagagctatgctggaaacagc

SEQ ID NO: 68959 - DNA, 70 bp, Artificial Sequence
  Synthetic
gccaagcatttaggtgacactataggtccatcaaagaactcacaagtttcagagctatgctggaaacagc

SEQ ID NO: 68960 - DNA, 70 bp, Artificial Sequence
  Synthetic
gccaagcatttaggtgacactatagatacataagagaggtcatacgtttcagagctatgctggaaacagc

SEQ ID NO: 68961 - DNA, 70 bp, Artificial Sequence
  Synthetic
gccaagcatttaggtgacactatagtgtgggaagccctttggtgggtttcagagctatgctggaaacagc

SEQ ID NO: 68962 - DNA, 70 bp, Artificial Sequence
  Synthetic
gccaagcatttaggtgacactataggaattctctggtgtctaacagtttcagagctatgctggaaacagc

SEQ ID NO: 68963 - DNA, 70 bp, Artificial Sequence
  Synthetic
gccaagcatttaggtgacactatagtctttagtgtgtgctctcacgtttcagagctatgctggaaacagc

SEQ ID NO: 68964 - DNA, 70 bp, Artificial Sequence
  Synthetic
gccaagcatttaggtgacactatagatttaggactcaggatctatgtttcagagctatgctggaaacagc

SEQ ID NO: 68965 - DNA, 70 bp, Artificial Sequence
  Synthetic
gccaagcatttaggtgacactatagatctaaagtctttaccacacgtttcagagctatgctggaaacagc

SEQ ID NO: 68966 - DNA, 70 bp, Artificial Sequence
  Synthetic
gccaagcatttaggtgacactatagtcaggaagatgaatttgagagtttcagagctatgctggaaacagc

SEQ ID NO: 68967 - DNA, 70 bp, Artificial Sequence
  Synthetic
gccaagcatttaggtgacactatagaagcccatcagagaattcatgtttcagagctatgctggaaacagc

SEQ ID NO: 68968 - DNA, 70 bp, Artificial Sequence
  Synthetic
gccaagcatttaggtgacactataggctgagggggtccagatcaggtttcagagctatgctggaaacagc

SEQ ID NO: 68969 - DNA, 70 bp, Artificial Sequence
  Synthetic
gccaagcatttaggtgacactatagccaccaggtggagcacaagggtttcagagctatgctggaaacagc

SEQ ID NO: 68970 - DNA, 70 bp, Artificial Sequence
  Synthetic
gccaagcatttaggtgacactataggctgcactcagagctcccccgtttcagagctatgctggaaacagc

SEQ ID NO: 68971 - DNA, 70 bp, Artificial Sequence
  Synthetic
gccaagcatttaggtgacactatagcctcacaaatgaagtgaatggtttcagagctatgctggaaacagc

SEQ ID NO: 68972 - DNA, 70 bp, Artificial Sequence
  Synthetic
gccaagcatttaggtgacactataggaagtctatgatgacatgcagtttcagagctatgctggaaacagc

SEQ ID NO: 68973 - DNA, 70 bp, Artificial Sequence
  Synthetic
gccaagcatttaggtgacactataggcagggcggcgaaggtcagggtttcagagctatgctggaaacagc

SEQ ID NO: 68974 - DNA, 70 bp, Artificial Sequence
  Synthetic
gccaagcatttaggtgacactatagaggccgggtctcgagcttaggtttcagagctatgctggaaacagc

SEQ ID NO: 68975 - DNA, 70 bp, Artificial Sequence
  Synthetic
gccaagcatttaggtgacactatagcggtggaagcatccatgagcgtttcagagctatgctggaaacagc

SEQ ID NO: 68976 - DNA, 70 bp, Artificial Sequence
  Synthetic
gccaagcatttaggtgacactatagtggggaaagcccattagcctgtttcagagctatgctggaaacagc

SEQ ID NO: 68977 - DNA, 70 bp, Artificial Sequence
  Synthetic
gccaagcatttaggtgacactatagattcaggagatgaaacctacgtttcagagctatgctggaaacagc

SEQ ID NO: 68978 - DNA, 70 bp, Artificial Sequence
  Synthetic
gccaagcatttaggtgacactatagctgtagctctttagatgctcgtttcagagctatgctggaaacagc

SEQ ID NO: 68979 - DNA, 70 bp, Artificial Sequence
  Synthetic
gccaagcatttaggtgacactatagggaggacagggcacatgggagtttcagagctatgctggaaacagc

SEQ ID NO: 68980 - DNA, 70 bp, Artificial Sequence
  Synthetic
gccaagcatttaggtgacactatagcacactgtttctctcaagcggtttcagagctatgctggaaacagc

SEQ ID NO: 68981 - DNA, 70 bp, Artificial Sequence
  Synthetic
gccaagcatttaggtgacactatagaagactggagttttcagcaagtttcagagctatgctggaaacagc

SEQ ID NO: 68982 - DNA, 70 bp, Artificial Sequence
  Synthetic
gccaagcatttaggtgacactatagagagagttcatactggaatggtttcagagctatgctggaaacagc

SEQ ID NO: 68983 - DNA, 70 bp, Artificial Sequence
  Synthetic
gccaagcatttaggtgacactatagaggatttcactatattgcccgtttcagagctatgctggaaacagc

SEQ ID NO: 68984 - DNA, 70 bp, Artificial Sequence
  Synthetic
gccaagcatttaggtgacactatagccttatgtgtgcagagattggtttcagagctatgctggaaacagc

SEQ ID NO: 68985 - DNA, 70 bp, Artificial Sequence
  Synthetic
gccaagcatttaggtgacactatagactgtcccctcaggtgtgacgtttcagagctatgctggaaacagc

SEQ ID NO: 68986 - DNA, 70 bp, Artificial Sequence
  Synthetic
gccaagcatttaggtgacactatagatggatacctctacctgacagtttcagagctatgctggaaacagc

SEQ ID NO: 68987 - DNA, 70 bp, Artificial Sequence
  Synthetic
gccaagcatttaggtgacactatagctcagatctcatcagacatcgtttcagagctatgctggaaacagc

SEQ ID NO: 68988 - DNA, 70 bp, Artificial Sequence
  Synthetic
gccaagcatttaggtgacactatagcaagcgaattcatactggcagtttcagagctatgctggaaacagc

SEQ ID NO: 68989 - DNA, 70 bp, Artificial Sequence
  Synthetic
gccaagcatttaggtgacactataggagttctctcatgttgtctagtttcagagctatgctggaaacagc

SEQ ID NO: 68990 - DNA, 70 bp, Artificial Sequence
  Synthetic
gccaagcatttaggtgacactatagcttgaaagttttcccacacagtttcagagctatgctggaaacagc

SEQ ID NO: 68991 - DNA, 70 bp, Artificial Sequence
  Synthetic
gccaagcatttaggtgacactatagcgggagctacgtgatgatccgtttcagagctatgctggaaacagc

SEQ ID NO: 68992 - DNA, 70 bp, Artificial Sequence
  Synthetic
gccaagcatttaggtgacactatagctctggtatgaatctttcgagtttcagagctatgctggaaacagc

SEQ ID NO: 68993 - DNA, 70 bp, Artificial Sequence
  Synthetic
gccaagcatttaggtgacactatagatcaggcagttcatggtgtagtttcagagctatgctggaaacagc

SEQ ID NO: 68994 - DNA, 70 bp, Artificial Sequence
  Synthetic
gccaagcatttaggtgacactatagaagctgcgacttcctgttgagtttcagagctatgctggaaacagc

SEQ ID NO: 68995 - DNA, 70 bp, Artificial Sequence
  Synthetic
gccaagcatttaggtgacactatagtctcttcactgtgatttctcgtttcagagctatgctggaaacagc

SEQ ID NO: 68996 - DNA, 70 bp, Artificial Sequence
  Synthetic
gccaagcatttaggtgacactatagtctctgatgtacttcaaggagtttcagagctatgctggaaacagc

SEQ ID NO: 68997 - DNA, 70 bp, Artificial Sequence
  Synthetic
gccaagcatttaggtgacactatagtctgcatctggaatgtttccgtttcagagctatgctggaaacagc

SEQ ID NO: 68998 - DNA, 70 bp, Artificial Sequence
  Synthetic
gccaagcatttaggtgacactatagcactctacccaccccccagggtttcagagctatgctggaaacagc

SEQ ID NO: 68999 - DNA, 70 bp, Artificial Sequence
  Synthetic
gccaagcatttaggtgacactatagttcactgcgtaccttacagagtttcagagctatgctggaaacagc

SEQ ID NO: 69000 - DNA, 70 bp, Artificial Sequence
  Synthetic
gccaagcatttaggtgacactatagcaagtgtaatgaatgtgggagtttcagagctatgctggaaacagc

SEQ ID NO: 69001 - DNA, 70 bp, Artificial Sequence
  Synthetic
gccaagcatttaggtgacactatagatctgctgagactgaacttcgtttcagagctatgctggaaacagc

SEQ ID NO: 69002 - DNA, 70 bp, Artificial Sequence
  Synthetic
gccaagcatttaggtgacactatagtctgcatgagttcacttatagtttcagagctatgctggaaacagc

SEQ ID NO: 69003 - DNA, 70 bp, Artificial Sequence
  Synthetic
gccaagcatttaggtgacactatagttaaacacaggagaattcacgtttcagagctatgctggaaacagc

SEQ ID NO: 69004 - DNA, 70 bp, Artificial Sequence
  Synthetic
gccaagcatttaggtgacactataggaattctttggtgtttgctggtttcagagctatgctggaaacagc

SEQ ID NO: 69005 - DNA, 70 bp, Artificial Sequence
  Synthetic
gccaagcatttaggtgacactatagagtcaagtcttaaagcatgtgtttcagagctatgctggaaacagc

SEQ ID NO: 69006 - DNA, 70 bp, Artificial Sequence
  Synthetic
gccaagcatttaggtgacactataggagaacgtgacggggcttacgtttcagagctatgctggaaacagc

SEQ ID NO: 69007 - DNA, 70 bp, Artificial Sequence
  Synthetic
gccaagcatttaggtgacactatagaagacacctgtccaagcatagtttcagagctatgctggaaacagc

SEQ ID NO: 69008 - DNA, 70 bp, Artificial Sequence
  Synthetic
gccaagcatttaggtgacactatagctgccaagataaagctcatggtttcagagctatgctggaaacagc

SEQ ID NO: 69009 - DNA, 70 bp, Artificial Sequence
  Synthetic
gccaagcatttaggtgacactataggaggtggatcagttgaggtcgtttcagagctatgctggaaacagc

SEQ ID NO: 69010 - DNA, 70 bp, Artificial Sequence
  Synthetic
gccaagcatttaggtgacactatagcagactctcagaatctcactgtttcagagctatgctggaaacagc

SEQ ID NO: 69011 - DNA, 70 bp, Artificial Sequence
  Synthetic
gccaagcatttaggtgacactataggtagataagggggaacacacgtttcagagctatgctggaaacagc

SEQ ID NO: 69012 - DNA, 70 bp, Artificial Sequence
  Synthetic
gccaagcatttaggtgacactatagaaggctcgaactactcctgagtttcagagctatgctggaaacagc

SEQ ID NO: 69013 - DNA, 70 bp, Artificial Sequence
  Synthetic
gccaagcatttaggtgacactatagattaagcaatcttctcgcctgtttcagagctatgctggaaacagc

SEQ ID NO: 69014 - DNA, 70 bp, Artificial Sequence
  Synthetic
gccaagcatttaggtgacactatagaaggtgtgaggaccgcttgagtttcagagctatgctggaaacagc

SEQ ID NO: 69015 - DNA, 70 bp, Artificial Sequence
  Synthetic
gccaagcatttaggtgacactatagatatgtcatgaagaggacttgtttcagagctatgctggaaacagc

SEQ ID NO: 69016 - DNA, 70 bp, Artificial Sequence
  Synthetic
gccaagcatttaggtgacactatagtttcatgctcatgaaagaacgtttcagagctatgctggaaacagc

SEQ ID NO: 69017 - DNA, 70 bp, Artificial Sequence
  Synthetic
gccaagcatttaggtgacactatagcagctggtgcacacgttttggtttcagagctatgctggaaacagc

SEQ ID NO: 69018 - DNA, 70 bp, Artificial Sequence
  Synthetic
gccaagcatttaggtgacactatagccaggtgtctccctgtgaaagtttcagagctatgctggaaacagc

SEQ ID NO: 69019 - DNA, 70 bp, Artificial Sequence
  Synthetic
gccaagcatttaggtgacactatagtacaaggtgtctttcctatagtttcagagctatgctggaaacagc

SEQ ID NO: 69020 - DNA, 70 bp, Artificial Sequence
  Synthetic
gccaagcatttaggtgacactataggaaagaagctctaggtgattgtttcagagctatgctggaaacagc

SEQ ID NO: 69021 - DNA, 70 bp, Artificial Sequence
  Synthetic
gccaagcatttaggtgacactatagaatcaagttgtctcatggacgtttcagagctatgctggaaacagc

SEQ ID NO: 69022 - DNA, 70 bp, Artificial Sequence
  Synthetic
gccaagcatttaggtgacactatagccccggaacagctgggacaggtttcagagctatgctggaaacagc

SEQ ID NO: 69023 - DNA, 70 bp, Artificial Sequence
  Synthetic
gccaagcatttaggtgacactatagctggttctatgaagctgcttgtttcagagctatgctggaaacagc

SEQ ID NO: 69024 - DNA, 70 bp, Artificial Sequence
  Synthetic
gccaagcatttaggtgacactatagagaagacatagacggtattagtttcagagctatgctggaaacagc

SEQ ID NO: 69025 - DNA, 70 bp, Artificial Sequence
  Synthetic
gccaagcatttaggtgacactatagtttggagacttgaagttcaggtttcagagctatgctggaaacagc

SEQ ID NO: 69026 - DNA, 70 bp, Artificial Sequence
  Synthetic
gccaagcatttaggtgacactatagatgctatcttcactcgtcaggtttcagagctatgctggaaacagc

SEQ ID NO: 69027 - DNA, 70 bp, Artificial Sequence
  Synthetic
gccaagcatttaggtgacactatagtaactgtggcaatggtggcagtttcagagctatgctggaaacagc

SEQ ID NO: 69028 - DNA, 70 bp, Artificial Sequence
  Synthetic
gccaagcatttaggtgacactatagctgaactgttcttctctgccgtttcagagctatgctggaaacagc

SEQ ID NO: 69029 - DNA, 70 bp, Artificial Sequence
  Synthetic
gccaagcatttaggtgacactatagcagtggtcaggtgggtcagggtttcagagctatgctggaaacagc

SEQ ID NO: 69030 - DNA, 70 bp, Artificial Sequence
  Synthetic
gccaagcatttaggtgacactatagaagaaatgtcagacactcttgtttcagagctatgctggaaacagc

SEQ ID NO: 69031 - DNA, 70 bp, Artificial Sequence
  Synthetic
gccaagcatttaggtgacactatagaactagatgtgctctctgacgtttcagagctatgctggaaacagc

SEQ ID NO: 69032 - DNA, 70 bp, Artificial Sequence
  Synthetic
gccaagcatttaggtgacactatagatatctcacaatcgtggaaagtttcagagctatgctggaaacagc

SEQ ID NO: 69033 - DNA, 70 bp, Artificial Sequence
  Synthetic
gccaagcatttaggtgacactatagatggatttgggaagtcctgagtttcagagctatgctggaaacagc

SEQ ID NO: 69034 - DNA, 70 bp, Artificial Sequence
  Synthetic
gccaagcatttaggtgacactatagacaccagaggaaacataatggtttcagagctatgctggaaacagc

SEQ ID NO: 69035 - DNA, 70 bp, Artificial Sequence
  Synthetic
gccaagcatttaggtgacactatagaatctcaatcttggactcatgtttcagagctatgctggaaacagc

SEQ ID NO: 69036 - DNA, 70 bp, Artificial Sequence
  Synthetic
gccaagcatttaggtgacactatagtatggaaatgtgacctccctgtttcagagctatgctggaaacagc

SEQ ID NO: 69037 - DNA, 70 bp, Artificial Sequence
  Synthetic
gccaagcatttaggtgacactataggcactctctaatgttcaagagtttcagagctatgctggaaacagc

SEQ ID NO: 69038 - DNA, 70 bp, Artificial Sequence
  Synthetic
gccaagcatttaggtgacactataggatggtttctctcctttgtggtttcagagctatgctggaaacagc

SEQ ID NO: 69039 - DNA, 70 bp, Artificial Sequence
  Synthetic
gccaagcatttaggtgacactatagggccctgccacgctctgacggtttcagagctatgctggaaacagc

SEQ ID NO: 69040 - DNA, 70 bp, Artificial Sequence
  Synthetic
gccaagcatttaggtgacactatagcaaatgtaaccaatgtggcagtttcagagctatgctggaaacagc

SEQ ID NO: 69041 - DNA, 70 bp, Artificial Sequence
  Synthetic
gccaagcatttaggtgacactataggtgtattctgatgtcgaatcgtttcagagctatgctggaaacagc

SEQ ID NO: 69042 - DNA, 70 bp, Artificial Sequence
  Synthetic
gccaagcatttaggtgacactataggggggtcatgggcttcaggcgtttcagagctatgctggaaacagc

SEQ ID NO: 69043 - DNA, 70 bp, Artificial Sequence
  Synthetic
gccaagcatttaggtgacactatagctcaagcaatccacacgcctgtttcagagctatgctggaaacagc

SEQ ID NO: 69044 - DNA, 70 bp, Artificial Sequence
  Synthetic
gccaagcatttaggtgacactatagagcatgaaagagcttatatggtttcagagctatgctggaaacagc

SEQ ID NO: 69045 - DNA, 70 bp, Artificial Sequence
  Synthetic
gccaagcatttaggtgacactatagctgcaccagagggttcatgcgtttcagagctatgctggaaacagc

SEQ ID NO: 69046 - DNA, 70 bp, Artificial Sequence
  Synthetic
gccaagcatttaggtgacactatagaactaggacacagagaacccgtttcagagctatgctggaaacagc

SEQ ID NO: 69047 - DNA, 70 bp, Artificial Sequence
  Synthetic
gccaagcatttaggtgacactatagaaacatcagagaagtcacacgtttcagagctatgctggaaacagc

SEQ ID NO: 69048 - DNA, 70 bp, Artificial Sequence
  Synthetic
gccaagcatttaggtgacactatagctggagagaaactacagaacgtttcagagctatgctggaaacagc

SEQ ID NO: 69049 - DNA, 70 bp, Artificial Sequence
  Synthetic
gccaagcatttaggtgacactatagagacacaagagaattcatacgtttcagagctatgctggaaacagc

SEQ ID NO: 69050 - DNA, 70 bp, Artificial Sequence
  Synthetic
gccaagcatttaggtgacactataggatctccaaggtttgaacttgtttcagagctatgctggaaacagc

SEQ ID NO: 69051 - DNA, 70 bp, Artificial Sequence
  Synthetic
gccaagcatttaggtgacactatagacttactatggattgaggatgtttcagagctatgctggaaacagc

SEQ ID NO: 69052 - DNA, 70 bp, Artificial Sequence
  Synthetic
gccaagcatttaggtgacactatagtaagaggattcatactggaggtttcagagctatgctggaaacagc

SEQ ID NO: 69053 - DNA, 70 bp, Artificial Sequence
  Synthetic
gccaagcatttaggtgacactatagcttatgtctagtaaggtgtggtttcagagctatgctggaaacagc

SEQ ID NO: 69054 - DNA, 70 bp, Artificial Sequence
  Synthetic
gccaagcatttaggtgacactatagtgaagggctacatagtagccgtttcagagctatgctggaaacagc

SEQ ID NO: 69055 - DNA, 70 bp, Artificial Sequence
  Synthetic
gccaagcatttaggtgacactatagaaccagtcctcaaaccttacgtttcagagctatgctggaaacagc

SEQ ID NO: 69056 - DNA, 70 bp, Artificial Sequence
  Synthetic
gccaagcatttaggtgacactatagaaggtgtgagcaccgattaagtttcagagctatgctggaaacagc

SEQ ID NO: 69057 - DNA, 70 bp, Artificial Sequence
  Synthetic
gccaagcatttaggtgacactataggactcccctggtgatggggcgtttcagagctatgctggaaacagc

SEQ ID NO: 69058 - DNA, 70 bp, Artificial Sequence
  Synthetic
gccaagcatttaggtgacactatagccctatgaatgtaacagatggtttcagagctatgctggaaacagc

SEQ ID NO: 69059 - DNA, 70 bp, Artificial Sequence
  Synthetic
gccaagcatttaggtgacactatagggctcggcagggggctgttggtttcagagctatgctggaaacagc

SEQ ID NO: 69060 - DNA, 70 bp, Artificial Sequence
  Synthetic
gccaagcatttaggtgacactatagcttcgaggagtgcggctgaggtttcagagctatgctggaaacagc

SEQ ID NO: 69061 - DNA, 70 bp, Artificial Sequence
  Synthetic
gccaagcatttaggtgacactatagaggggcaacgcccattagaagtttcagagctatgctggaaacagc

SEQ ID NO: 69062 - DNA, 70 bp, Artificial Sequence
  Synthetic
gccaagcatttaggtgacactataggcctatgagtatcaggaatagtttcagagctatgctggaaacagc

SEQ ID NO: 69063 - DNA, 70 bp, Artificial Sequence
  Synthetic
gccaagcatttaggtgacactatagaaatggggctctccttcagcgtttcagagctatgctggaaacagc

SEQ ID NO: 69064 - DNA, 70 bp, Artificial Sequence
  Synthetic
gccaagcatttaggtgacactatagtggaggagagctcattgctggtttcagagctatgctggaaacagc

SEQ ID NO: 69065 - DNA, 70 bp, Artificial Sequence
  Synthetic
gccaagcatttaggtgacactataggggtcttcaaagcagctcgagtttcagagctatgctggaaacagc

SEQ ID NO: 69066 - DNA, 70 bp, Artificial Sequence
  Synthetic
gccaagcatttaggtgacactataggtacagcaagttgtgcagaggtttcagagctatgctggaaacagc

SEQ ID NO: 69067 - DNA, 70 bp, Artificial Sequence
  Synthetic
gccaagcatttaggtgacactataggtgcatggcgccgagtgagcgtttcagagctatgctggaaacagc

SEQ ID NO: 69068 - DNA, 70 bp, Artificial Sequence
  Synthetic
gccaagcatttaggtgacactatagagaagctgcacctgtgttaggtttcagagctatgctggaaacagc

SEQ ID NO: 69069 - DNA, 70 bp, Artificial Sequence
  Synthetic
gccaagcatttaggtgacactatagtttgtcctgcctactttcgagtttcagagctatgctggaaacagc

SEQ ID NO: 69070 - DNA, 70 bp, Artificial Sequence
  Synthetic
gccaagcatttaggtgacactataggggaacgtcagccatatggagtttcagagctatgctggaaacagc

SEQ ID NO: 69071 - DNA, 70 bp, Artificial Sequence
  Synthetic
gccaagcatttaggtgacactatagaagcttttaatcgtagctcagtttcagagctatgctggaaacagc

SEQ ID NO: 69072 - DNA, 70 bp, Artificial Sequence
  Synthetic
gccaagcatttaggtgacactatagccatcagaagattcattctggtttcagagctatgctggaaacagc

SEQ ID NO: 69073 - DNA, 70 bp, Artificial Sequence
  Synthetic
gccaagcatttaggtgacactataggggaaagcattcagctagccgtttcagagctatgctggaaacagc

SEQ ID NO: 69074 - DNA, 70 bp, Artificial Sequence
  Synthetic
gccaagcatttaggtgacactatagcgtcatcatagacttcatacgtttcagagctatgctggaaacagc

SEQ ID NO: 69075 - DNA, 70 bp, Artificial Sequence
  Synthetic
gccaagcatttaggtgacactatagggaggaagagctgtagttacgtttcagagctatgctggaaacagc

SEQ ID NO: 69076 - DNA, 70 bp, Artificial Sequence
  Synthetic
gccaagcatttaggtgacactataggcctgggggtctctcagtcggtttcagagctatgctggaaacagc

SEQ ID NO: 69077 - DNA, 70 bp, Artificial Sequence
  Synthetic
gccaagcatttaggtgacactatagatgttctctcatgtcatctagtttcagagctatgctggaaacagc

SEQ ID NO: 69078 - DNA, 70 bp, Artificial Sequence
  Synthetic
gccaagcatttaggtgacactataggtgttctctcatgtcatctagtttcagagctatgctggaaacagc

SEQ ID NO: 69079 - DNA, 70 bp, Artificial Sequence
  Synthetic
gccaagcatttaggtgacactatagaaggttggaagacagactgagtttcagagctatgctggaaacagc

SEQ ID NO: 69080 - DNA, 70 bp, Artificial Sequence
  Synthetic
gccaagcatttaggtgacactatagttagctgatgttcaggcatagtttcagagctatgctggaaacagc

SEQ ID NO: 69081 - DNA, 70 bp, Artificial Sequence
  Synthetic
gccaagcatttaggtgacactatagacaggcacggggaggtgtaggtttcagagctatgctggaaacagc

SEQ ID NO: 69082 - DNA, 70 bp, Artificial Sequence
  Synthetic
gccaagcatttaggtgacactatagacatttgtagggtttctcttgtttcagagctatgctggaaacagc

SEQ ID NO: 69083 - DNA, 70 bp, Artificial Sequence
  Synthetic
gccaagcatttaggtgacactatagttcatgtattcgaaaggaacgtttcagagctatgctggaaacagc

SEQ ID NO: 69084 - DNA, 70 bp, Artificial Sequence
  Synthetic
gccaagcatttaggtgacactataggcgctcaggtgtgaatccgcgtttcagagctatgctggaaacagc

SEQ ID NO: 69085 - DNA, 70 bp, Artificial Sequence
  Synthetic
gccaagcatttaggtgacactataggcgctatagcacattgtagtgtttcagagctatgctggaaacagc

SEQ ID NO: 69086 - DNA, 70 bp, Artificial Sequence
  Synthetic
gccaagcatttaggtgacactatagattacataagagcctctttggtttcagagctatgctggaaacagc

SEQ ID NO: 69087 - DNA, 70 bp, Artificial Sequence
  Synthetic
gccaagcatttaggtgacactatagagttatgtgctgctaaatgagtttcagagctatgctggaaacagc

SEQ ID NO: 69088 - DNA, 70 bp, Artificial Sequence
  Synthetic
gccaagcatttaggtgacactatagggtgagcagatcgcgaggtcgtttcagagctatgctggaaacagc

SEQ ID NO: 69089 - DNA, 70 bp, Artificial Sequence
  Synthetic
gccaagcatttaggtgacactatagactcataagaggattcatacgtttcagagctatgctggaaacagc

SEQ ID NO: 69090 - DNA, 70 bp, Artificial Sequence
  Synthetic
gccaagcatttaggtgacactataggatcacagctagtttgttacgtttcagagctatgctggaaacagc

SEQ ID NO: 69091 - DNA, 70 bp, Artificial Sequence
  Synthetic
gccaagcatttaggtgacactatagaaatctgacgtagctgaggcgtttcagagctatgctggaaacagc

SEQ ID NO: 69092 - DNA, 70 bp, Artificial Sequence
  Synthetic
gccaagcatttaggtgacactataggagcctggtggagctccagggtttcagagctatgctggaaacagc

SEQ ID NO: 69093 - DNA, 70 bp, Artificial Sequence
  Synthetic
gccaagcatttaggtgacactatagcataagagaactcatactgggtttcagagctatgctggaaacagc

SEQ ID NO: 69094 - DNA, 70 bp, Artificial Sequence
  Synthetic
gccaagcatttaggtgacactatagaggaaagagtgggaaagtgagtttcagagctatgctggaaacagc

SEQ ID NO: 69095 - DNA, 70 bp, Artificial Sequence
  Synthetic
gccaagcatttaggtgacactatagaagatttgcagactgtctaagtttcagagctatgctggaaacagc

SEQ ID NO: 69096 - DNA, 70 bp, Artificial Sequence
  Synthetic
gccaagcatttaggtgacactataggtttagtaagggttgaggatgtttcagagctatgctggaaacagc

SEQ ID NO: 69097 - DNA, 70 bp, Artificial Sequence
  Synthetic
gccaagcatttaggtgacactatagaggcaggcattttaaattacgtttcagagctatgctggaaacagc

SEQ ID NO: 69098 - DNA, 70 bp, Artificial Sequence
  Synthetic
gccaagcatttaggtgacactatagcagtagtcaaatactcaggtgtttcagagctatgctggaaacagc

SEQ ID NO: 69099 - DNA, 70 bp, Artificial Sequence
  Synthetic
gccaagcatttaggtgacactatagccttacaagtgtgacgaatggtttcagagctatgctggaaacagc

SEQ ID NO: 69100 - DNA, 70 bp, Artificial Sequence
  Synthetic
gccaagcatttaggtgacactatagtgtattcactctcacctaccgtttcagagctatgctggaaacagc

SEQ ID NO: 69101 - DNA, 70 bp, Artificial Sequence
  Synthetic
gccaagcatttaggtgacactatagaaggtctgagaaccacctaagtttcagagctatgctggaaacagc

SEQ ID NO: 69102 - DNA, 70 bp, Artificial Sequence
  Synthetic
gccaagcatttaggtgacactatagcttatgagtagtaaggtgtggtttcagagctatgctggaaacagc

SEQ ID NO: 69103 - DNA, 70 bp, Artificial Sequence
  Synthetic
gccaagcatttaggtgacactatagggcacattcttcacatttgtgtttcagagctatgctggaaacagc

SEQ ID NO: 69104 - DNA, 70 bp, Artificial Sequence
  Synthetic
gccaagcatttaggtgacactatagggcggttctcacaccttactgtttcagagctatgctggaaacagc

SEQ ID NO: 69105 - DNA, 70 bp, Artificial Sequence
  Synthetic
gccaagcatttaggtgacactatagaaggtatgaggaccacttaagtttcagagctatgctggaaacagc

SEQ ID NO: 69106 - DNA, 70 bp, Artificial Sequence
  Synthetic
gccaagcatttaggtgacactatagtaactgctcctcaactgtaagtttcagagctatgctggaaacagc

SEQ ID NO: 69107 - DNA, 70 bp, Artificial Sequence
  Synthetic
gccaagcatttaggtgacactatagaatgtggcaaagcatcgagcgtttcagagctatgctggaaacagc

SEQ ID NO: 69108 - DNA, 70 bp, Artificial Sequence
  Synthetic
gccaagcatttaggtgacactatagagccaaacacccaggtaggtgtttcagagctatgctggaaacagc

SEQ ID NO: 69109 - DNA, 70 bp, Artificial Sequence
  Synthetic
gccaagcatttaggtgacactatagctctacccttactacacatagtttcagagctatgctggaaacagc

SEQ ID NO: 69110 - DNA, 70 bp, Artificial Sequence
  Synthetic
gccaagcatttaggtgacactatagagcacatcatgttagtttcggtttcagagctatgctggaaacagc

SEQ ID NO: 69111 - DNA, 70 bp, Artificial Sequence
  Synthetic
gccaagcatttaggtgacactatagcgacgggcagttttctctatgtttcagagctatgctggaaacagc

SEQ ID NO: 69112 - DNA, 70 bp, Artificial Sequence
  Synthetic
gccaagcatttaggtgacactatagcctgggacccaccgatggcggtttcagagctatgctggaaacagc

SEQ ID NO: 69113 - DNA, 70 bp, Artificial Sequence
  Synthetic
gccaagcatttaggtgacactatagcgccgggtctcctgggctgagtttcagagctatgctggaaacagc

SEQ ID NO: 69114 - DNA, 70 bp, Artificial Sequence
  Synthetic
gccaagcatttaggtgacactatagtattccaggaatgtgggtgagtttcagagctatgctggaaacagc

SEQ ID NO: 69115 - DNA, 70 bp, Artificial Sequence
  Synthetic
gccaagcatttaggtgacactatagatactggaaaaaggccttaggtttcagagctatgctggaaacagc

SEQ ID NO: 69116 - DNA, 70 bp, Artificial Sequence
  Synthetic
gccaagcatttaggtgacactataggaacccggcgttaggacaccgtttcagagctatgctggaaacagc

SEQ ID NO: 69117 - DNA, 70 bp, Artificial Sequence
  Synthetic
gccaagcatttaggtgacactatagctggacaagcttctcttcacgtttcagagctatgctggaaacagc

SEQ ID NO: 69118 - DNA, 70 bp, Artificial Sequence
  Synthetic
gccaagcatttaggtgacactataggcacgtcttgcctgagtcccgtttcagagctatgctggaaacagc

SEQ ID NO: 69119 - DNA, 70 bp, Artificial Sequence
  Synthetic
gccaagcatttaggtgacactatagtctagacaggagatcactttgtttcagagctatgctggaaacagc

SEQ ID NO: 69120 - DNA, 70 bp, Artificial Sequence
  Synthetic
gccaagcatttaggtgacactatagcatggtaactttcctcagttgtttcagagctatgctggaaacagc

SEQ ID NO: 69121 - DNA, 70 bp, Artificial Sequence
  Synthetic
gccaagcatttaggtgacactataggagacaacagtgtcggagaggtttcagagctatgctggaaacagc

SEQ ID NO: 69122 - DNA, 70 bp, Artificial Sequence
  Synthetic
gccaagcatttaggtgacactataggaagtctacgatggcatgtagtttcagagctatgctggaaacagc

SEQ ID NO: 69123 - DNA, 70 bp, Artificial Sequence
  Synthetic
gccaagcatttaggtgacactataggaggaggatctcttgagctcgtttcagagctatgctggaaacagc

SEQ ID NO: 69124 - DNA, 70 bp, Artificial Sequence
  Synthetic
gccaagcatttaggtgacactatagacacacctaagaatgcgctcgtttcagagctatgctggaaacagc

SEQ ID NO: 69125 - DNA, 70 bp, Artificial Sequence
  Synthetic
gccaagcatttaggtgacactatagtattccaggagtgtgggtgagtttcagagctatgctggaaacagc

SEQ ID NO: 69126 - DNA, 70 bp, Artificial Sequence
  Synthetic
gccaagcatttaggtgacactatagtaccatcatagacttcatacgtttcagagctatgctggaaacagc

SEQ ID NO: 69127 - DNA, 70 bp, Artificial Sequence
  Synthetic
gccaagcatttaggtgacactatagtttgccaaactcagtttgtagtttcagagctatgctggaaacagc

SEQ ID NO: 69128 - DNA, 70 bp, Artificial Sequence
  Synthetic
gccaagcatttaggtgacactataggcggcgggccggcgctgaccgtttcagagctatgctggaaacagc

SEQ ID NO: 69129 - DNA, 70 bp, Artificial Sequence
  Synthetic
gccaagcatttaggtgacactataggcacatgtgagaacacatgcgtttcagagctatgctggaaacagc

SEQ ID NO: 69130 - DNA, 70 bp, Artificial Sequence
  Synthetic
gccaagcatttaggtgacactataggaaagtggttgccttagattgtttcagagctatgctggaaacagc

SEQ ID NO: 69131 - DNA, 70 bp, Artificial Sequence
  Synthetic
gccaagcatttaggtgacactataggagcgttgcccggagtgtgagtttcagagctatgctggaaacagc

SEQ ID NO: 69132 - DNA, 70 bp, Artificial Sequence
  Synthetic
gccaagcatttaggtgacactatagactggagaaaggccttaggagtttcagagctatgctggaaacagc

SEQ ID NO: 69133 - DNA, 70 bp, Artificial Sequence
  Synthetic
gccaagcatttaggtgacactatagaaacatcgaaggattcacacgtttcagagctatgctggaaacagc

SEQ ID NO: 69134 - DNA, 70 bp, Artificial Sequence
  Synthetic
gccaagcatttaggtgacactatagtcttcactcacgtccctgttgtttcagagctatgctggaaacagc

SEQ ID NO: 69135 - DNA, 70 bp, Artificial Sequence
  Synthetic
gccaagcatttaggtgacactatagataaaagatgcgctttctgagtttcagagctatgctggaaacagc

SEQ ID NO: 69136 - DNA, 70 bp, Artificial Sequence
  Synthetic
gccaagcatttaggtgacactatagccaaggaggaggcgcgctaggtttcagagctatgctggaaacagc

SEQ ID NO: 69137 - DNA, 70 bp, Artificial Sequence
  Synthetic
gccaagcatttaggtgacactatagaaacatcaacgagttcacacgtttcagagctatgctggaaacagc

SEQ ID NO: 69138 - DNA, 70 bp, Artificial Sequence
  Synthetic
gccaagcatttaggtgacactatagccaggagttgaacatcagtcgtttcagagctatgctggaaacagc

SEQ ID NO: 69139 - DNA, 70 bp, Artificial Sequence
  Synthetic
gccaagcatttaggtgacactatagcgcgcgctcactcgcccgtggtttcagagctatgctggaaacagc

SEQ ID NO: 69140 - DNA, 70 bp, Artificial Sequence
  Synthetic
gccaagcatttaggtgacactatagcagtgtgaatttgagtgtgagtttcagagctatgctggaaacagc

SEQ ID NO: 69141 - DNA, 70 bp, Artificial Sequence
  Synthetic
gccaagcatttaggtgacactatagatttgagcgcctacattcatgtttcagagctatgctggaaacagc

SEQ ID NO: 69142 - DNA, 70 bp, Artificial Sequence
  Synthetic
gccaagcatttaggtgacactataggaacattcacacaggtgagagtttcagagctatgctggaaacagc

SEQ ID NO: 69143 - DNA, 70 bp, Artificial Sequence
  Synthetic
gccaagcatttaggtgacactatagaagttgctactgatgtctgagtttcagagctatgctggaaacagc

SEQ ID NO: 69144 - DNA, 70 bp, Artificial Sequence
  Synthetic
gccaagcatttaggtgacactatagtagatgtgcattatgcttgagtttcagagctatgctggaaacagc

SEQ ID NO: 69145 - DNA, 70 bp, Artificial Sequence
  Synthetic
gccaagcatttaggtgacactatagtatgcatacatttaatccccgtttcagagctatgctggaaacagc

SEQ ID NO: 69146 - DNA, 70 bp, Artificial Sequence
  Synthetic
gccaagcatttaggtgacactatagcggaaggaggagggctgaccgtttcagagctatgctggaaacagc

SEQ ID NO: 69147 - DNA, 70 bp, Artificial Sequence
  Synthetic
gccaagcatttaggtgacactataggtccctggtctgcagcctacgtttcagagctatgctggaaacagc

SEQ ID NO: 69148 - DNA, 70 bp, Artificial Sequence
  Synthetic
gccaagcatttaggtgacactatagtatttcaagagtgtgggtgagtttcagagctatgctggaaacagc

SEQ ID NO: 69149 - DNA, 70 bp, Artificial Sequence
  Synthetic
gccaagcatttaggtgacactatagatagaggccgattggagttggtttcagagctatgctggaaacagc

SEQ ID NO: 69150 - DNA, 70 bp, Artificial Sequence
  Synthetic
gccaagcatttaggtgacactataggcagcacccccgtctgttgagtttcagagctatgctggaaacagc

SEQ ID NO: 69151 - DNA, 70 bp, Artificial Sequence
  Synthetic
gccaagcatttaggtgacactatagcccccgggcccctcccctacgtttcagagctatgctggaaacagc

SEQ ID NO: 69152 - DNA, 70 bp, Artificial Sequence
  Synthetic
gccaagcatttaggtgacactatagttcccacattgtttattcacgtttcagagctatgctggaaacagc

SEQ ID NO: 69153 - DNA, 70 bp, Artificial Sequence
  Synthetic
gccaagcatttaggtgacactatagaagcaccagggcactcacaagtttcagagctatgctggaaacagc

SEQ ID NO: 69154 - DNA, 70 bp, Artificial Sequence
  Synthetic
gccaagcatttaggtgacactataggccagagacgttcagcacaggtttcagagctatgctggaaacagc

SEQ ID NO: 69155 - DNA, 70 bp, Artificial Sequence
  Synthetic
gccaagcatttaggtgacactatagtcctggaggtcttacagatggtttcagagctatgctggaaacagc

SEQ ID NO: 69156 - DNA, 70 bp, Artificial Sequence
  Synthetic
gccaagcatttaggtgacactatagctccacgccggagagtaactgtttcagagctatgctggaaacagc

SEQ ID NO: 69157 - DNA, 70 bp, Artificial Sequence
  Synthetic
gccaagcatttaggtgacactatagtctgtgaatggacagactatgtttcagagctatgctggaaacagc

SEQ ID NO: 69158 - DNA, 70 bp, Artificial Sequence
  Synthetic
gccaagcatttaggtgacactatagtaaggatgtggacacactgagtttcagagctatgctggaaacagc

SEQ ID NO: 69159 - DNA, 70 bp, Artificial Sequence
  Synthetic
gccaagcatttaggtgacactatagccaccctggggaggttccctgtttcagagctatgctggaaacagc

SEQ ID NO: 69160 - DNA, 70 bp, Artificial Sequence
  Synthetic
gccaagcatttaggtgacactatagatgctcggaagaatgcctacgtttcagagctatgctggaaacagc

SEQ ID NO: 69161 - DNA, 70 bp, Artificial Sequence
  Synthetic
gccaagcatttaggtgacactatagcgtatggatgtaaggaatgtgtttcagagctatgctggaaacagc

SEQ ID NO: 69162 - DNA, 70 bp, Artificial Sequence
  Synthetic
gccaagcatttaggtgacactatagagcaaagtttctctcctatggtttcagagctatgctggaaacagc

SEQ ID NO: 69163 - DNA, 70 bp, Artificial Sequence
  Synthetic
gccaagcatttaggtgacactatagcccacatcatttgcactcaagtttcagagctatgctggaaacagc

SEQ ID NO: 69164 - DNA, 70 bp, Artificial Sequence
  Synthetic
gccaagcatttaggtgacactatagaggccgaagtacaagatctagtttcagagctatgctggaaacagc

SEQ ID NO: 69165 - DNA, 70 bp, Artificial Sequence
  Synthetic
gccaagcatttaggtgacactatagtatggtgatgactagaagaggtttcagagctatgctggaaacagc

SEQ ID NO: 69166 - DNA, 70 bp, Artificial Sequence
  Synthetic
gccaagcatttaggtgacactatagcaagtgtgtggacacatttagtttcagagctatgctggaaacagc

SEQ ID NO: 69167 - DNA, 70 bp, Artificial Sequence
  Synthetic
gccaagcatttaggtgacactatagatcaggcaattcatggtatagtttcagagctatgctggaaacagc

SEQ ID NO: 69168 - DNA, 70 bp, Artificial Sequence
  Synthetic
gccaagcatttaggtgacactataggcatactgagaactgatttcgtttcagagctatgctggaaacagc

SEQ ID NO: 69169 - DNA, 70 bp, Artificial Sequence
  Synthetic
gccaagcatttaggtgacactatagtgacaatcctcacactcatagtttcagagctatgctggaaacagc

SEQ ID NO: 69170 - DNA, 70 bp, Artificial Sequence
  Synthetic
gccaagcatttaggtgacactatagtcaagcaatccatgggtgtagtttcagagctatgctggaaacagc

SEQ ID NO: 69171 - DNA, 70 bp, Artificial Sequence
  Synthetic
gccaagcatttaggtgacactatagatttgccactctcattacatgtttcagagctatgctggaaacagc

SEQ ID NO: 69172 - DNA, 70 bp, Artificial Sequence
  Synthetic
gccaagcatttaggtgacactataggctgctgttctgctcttcaagtttcagagctatgctggaaacagc

SEQ ID NO: 69173 - DNA, 70 bp, Artificial Sequence
  Synthetic
gccaagcatttaggtgacactatagatagacataaaaggactcacgtttcagagctatgctggaaacagc

SEQ ID NO: 69174 - DNA, 70 bp, Artificial Sequence
  Synthetic
gccaagcatttaggtgacactataggccacactgtccccaccggtgtttcagagctatgctggaaacagc

SEQ ID NO: 69175 - DNA, 70 bp, Artificial Sequence
  Synthetic
gccaagcatttaggtgacactatagcccaccggtgggctcaagtagtttcagagctatgctggaaacagc

SEQ ID NO: 69176 - DNA, 70 bp, Artificial Sequence
  Synthetic
gccaagcatttaggtgacactatagcgccatgagggaattcatacgtttcagagctatgctggaaacagc

SEQ ID NO: 69177 - DNA, 70 bp, Artificial Sequence
  Synthetic
gccaagcatttaggtgacactatagcgtcatcagagatttcatgcgtttcagagctatgctggaaacagc

SEQ ID NO: 69178 - DNA, 70 bp, Artificial Sequence
  Synthetic
gccaagcatttaggtgacactataggtgaaaggggcattgttatagtttcagagctatgctggaaacagc

SEQ ID NO: 69179 - DNA, 70 bp, Artificial Sequence
  Synthetic
gccaagcatttaggtgacactatagtcggtcttcatcgtcgctgcgtttcagagctatgctggaaacagc

SEQ ID NO: 69180 - DNA, 70 bp, Artificial Sequence
  Synthetic
gccaagcatttaggtgacactatagctcagctcttaatcttctgcgtttcagagctatgctggaaacagc

SEQ ID NO: 69181 - DNA, 70 bp, Artificial Sequence
  Synthetic
gccaagcatttaggtgacactatagtagatgttctcctaacttctgtttcagagctatgctggaaacagc

SEQ ID NO: 69182 - DNA, 70 bp, Artificial Sequence
  Synthetic
gccaagcatttaggtgacactatagggctccctgcagtcaaggcggtttcagagctatgctggaaacagc

SEQ ID NO: 69183 - DNA, 70 bp, Artificial Sequence
  Synthetic
gccaagcatttaggtgacactatagtctagaggaactccttctaggtttcagagctatgctggaaacagc

SEQ ID NO: 69184 - DNA, 70 bp, Artificial Sequence
  Synthetic
gccaagcatttaggtgacactatagccttatcgatgcattgaatggtttcagagctatgctggaaacagc

SEQ ID NO: 69185 - DNA, 70 bp, Artificial Sequence
  Synthetic
gccaagcatttaggtgacactatagaaattatttggggatcccaggtttcagagctatgctggaaacagc

SEQ ID NO: 69186 - DNA, 70 bp, Artificial Sequence
  Synthetic
gccaagcatttaggtgacactatagtgcaggctttataggaaacagtttcagagctatgctggaaacagc

SEQ ID NO: 69187 - DNA, 70 bp, Artificial Sequence
  Synthetic
gccaagcatttaggtgacactataggcacgctggttcttcagtgtgtttcagagctatgctggaaacagc

SEQ ID NO: 69188 - DNA, 70 bp, Artificial Sequence
  Synthetic
gccaagcatttaggtgacactatagagacataaaagggctcacacgtttcagagctatgctggaaacagc

SEQ ID NO: 69189 - DNA, 70 bp, Artificial Sequence
  Synthetic
gccaagcatttaggtgacactatagttacaaggactgaattgtgagtttcagagctatgctggaaacagc

SEQ ID NO: 69190 - DNA, 70 bp, Artificial Sequence
  Synthetic
gccaagcatttaggtgacactataggttcacacacgaactcacacgtttcagagctatgctggaaacagc

SEQ ID NO: 69191 - DNA, 70 bp, Artificial Sequence
  Synthetic
gccaagcatttaggtgacactatagttacacatgcgaattcacacgtttcagagctatgctggaaacagc

SEQ ID NO: 69192 - DNA, 70 bp, Artificial Sequence
  Synthetic
gccaagcatttaggtgacactatagcatagaggaatacctgagaggtttcagagctatgctggaaacagc

SEQ ID NO: 69193 - DNA, 70 bp, Artificial Sequence
  Synthetic
gccaagcatttaggtgacactataggtttagtaaggtttgaggacgtttcagagctatgctggaaacagc

SEQ ID NO: 69194 - DNA, 70 bp, Artificial Sequence
  Synthetic
gccaagcatttaggtgacactatagaagctgtgtaagctgtttaagtttcagagctatgctggaaacagc

SEQ ID NO: 69195 - DNA, 70 bp, Artificial Sequence
  Synthetic
gccaagcatttaggtgacactatagctggctcggtcatcttcttagtttcagagctatgctggaaacagc

SEQ ID NO: 69196 - DNA, 70 bp, Artificial Sequence
  Synthetic
gccaagcatttaggtgacactatagccgcagacaaggcgctgtgagtttcagagctatgctggaaacagc

SEQ ID NO: 69197 - DNA, 70 bp, Artificial Sequence
  Synthetic
gccaagcatttaggtgacactataggtggcaaggtcttcagttaggtttcagagctatgctggaaacagc

SEQ ID NO: 69198 - DNA, 70 bp, Artificial Sequence
  Synthetic
gccaagcatttaggtgacactatagaggcccccgggatgtcctgagtttcagagctatgctggaaacagc

SEQ ID NO: 69199 - DNA, 70 bp, Artificial Sequence
  Synthetic
gccaagcatttaggtgacactatagcctcggtcaggcatccttccgtttcagagctatgctggaaacagc

SEQ ID NO: 69200 - DNA, 70 bp, Artificial Sequence
  Synthetic
gccaagcatttaggtgacactatagaagcatgtaaggactcacgcgtttcagagctatgctggaaacagc

SEQ ID NO: 69201 - DNA, 70 bp, Artificial Sequence
  Synthetic
gccaagcatttaggtgacactatagacacatgagaattcatacaggtttcagagctatgctggaaacagc

SEQ ID NO: 69202 - DNA, 70 bp, Artificial Sequence
  Synthetic
gccaagcatttaggtgacactatagccacacacatttcatctgtagtttcagagctatgctggaaacagc

SEQ ID NO: 69203 - DNA, 70 bp, Artificial Sequence
  Synthetic
gccaagcatttaggtgacactatagccctatcaatgtactaagtggtttcagagctatgctggaaacagc

SEQ ID NO: 69204 - DNA, 70 bp, Artificial Sequence
  Synthetic
gccaagcatttaggtgacactatagatcaggcaatccatggtgtagtttcagagctatgctggaaacagc

SEQ ID NO: 69205 - DNA, 70 bp, Artificial Sequence
  Synthetic
gccaagcatttaggtgacactatagtccacattcataacacttacgtttcagagctatgctggaaacagc

SEQ ID NO: 69206 - DNA, 70 bp, Artificial Sequence
  Synthetic
gccaagcatttaggtgacactatagagcctacatagtgaagaacagtttcagagctatgctggaaacagc

SEQ ID NO: 69207 - DNA, 70 bp, Artificial Sequence
  Synthetic
gccaagcatttaggtgacactatagctactttgggaggccgaggcgtttcagagctatgctggaaacagc

SEQ ID NO: 69208 - DNA, 70 bp, Artificial Sequence
  Synthetic
gccaagcatttaggtgacactatagaaaccctgcaaacatgaatggtttcagagctatgctggaaacagc

SEQ ID NO: 69209 - DNA, 70 bp, Artificial Sequence
  Synthetic
gccaagcatttaggtgacactatagctcatgtctactaaggcttggtttcagagctatgctggaaacagc

SEQ ID NO: 69210 - DNA, 70 bp, Artificial Sequence
  Synthetic
gccaagcatttaggtgacactataggccgcattcttcacacttgtgtttcagagctatgctggaaacagc

SEQ ID NO: 69211 - DNA, 70 bp, Artificial Sequence
  Synthetic
gccaagcatttaggtgacactatagaatgtggtaaagcttttcaggtttcagagctatgctggaaacagc

SEQ ID NO: 69212 - DNA, 70 bp, Artificial Sequence
  Synthetic
gccaagcatttaggtgacactatagggagatccaggggatgatgtgtttcagagctatgctggaaacagc

SEQ ID NO: 69213 - DNA, 70 bp, Artificial Sequence
  Synthetic
gccaagcatttaggtgacactatagtggggacccaccaggagaccgtttcagagctatgctggaaacagc

SEQ ID NO: 69214 - DNA, 70 bp, Artificial Sequence
  Synthetic
gccaagcatttaggtgacactataggaggagctccctagctgaacgtttcagagctatgctggaaacagc

SEQ ID NO: 69215 - DNA, 70 bp, Artificial Sequence
  Synthetic
gccaagcatttaggtgacactatagcagaatgaggagtcttaagagtttcagagctatgctggaaacagc

SEQ ID NO: 69216 - DNA, 70 bp, Artificial Sequence
  Synthetic
gccaagcatttaggtgacactatagcaaaaattggttgggcgtaggtttcagagctatgctggaaacagc

SEQ ID NO: 69217 - DNA, 70 bp, Artificial Sequence
  Synthetic
gccaagcatttaggtgacactatagtaccaaaaccgtaaagcctggtttcagagctatgctggaaacagc

SEQ ID NO: 69218 - DNA, 70 bp, Artificial Sequence
  Synthetic
gccaagcatttaggtgacactatagagtgaatctaccaagaacgtgtttcagagctatgctggaaacagc

SEQ ID NO: 69219 - DNA, 70 bp, Artificial Sequence
  Synthetic
gccaagcatttaggtgacactataggtcaagagtcttccttctccgtttcagagctatgctggaaacagc

SEQ ID NO: 69220 - DNA, 70 bp, Artificial Sequence
  Synthetic
gccaagcatttaggtgacactatagaagcccgcaggtcagtccgcgtttcagagctatgctggaaacagc

SEQ ID NO: 69221 - DNA, 70 bp, Artificial Sequence
  Synthetic
gccaagcatttaggtgacactataggaagctgacgcttaatctgagtttcagagctatgctggaaacagc

SEQ ID NO: 69222 - DNA, 70 bp, Artificial Sequence
  Synthetic
gccaagcatttaggtgacactatagtcctcctgagctcaggctccgtttcagagctatgctggaaacagc

SEQ ID NO: 69223 - DNA, 70 bp, Artificial Sequence
  Synthetic
gccaagcatttaggtgacactataggccctagatctttactgaccgtttcagagctatgctggaaacagc

SEQ ID NO: 69224 - DNA, 70 bp, Artificial Sequence
  Synthetic
gccaagcatttaggtgacactataggaaagcaacagacagtgaatgtttcagagctatgctggaaacagc

SEQ ID NO: 69225 - DNA, 70 bp, Artificial Sequence
  Synthetic
gccaagcatttaggtgacactatagtctactacctgtacgagaaagtttcagagctatgctggaaacagc

SEQ ID NO: 69226 - DNA, 70 bp, Artificial Sequence
  Synthetic
gccaagcatttaggtgacactatagttttattcggaagcagacacgtttcagagctatgctggaaacagc

SEQ ID NO: 69227 - DNA, 70 bp, Artificial Sequence
  Synthetic
gccaagcatttaggtgacactatagctgtttcttgacagccaagtgtttcagagctatgctggaaacagc

SEQ ID NO: 69228 - DNA, 70 bp, Artificial Sequence
  Synthetic
gccaagcatttaggtgacactatagtgcaatagcagcctggtgtagtttcagagctatgctggaaacagc

SEQ ID NO: 69229 - DNA, 70 bp, Artificial Sequence
  Synthetic
gccaagcatttaggtgacactatagtgggcaagatttagctccatgtttcagagctatgctggaaacagc

SEQ ID NO: 69230 - DNA, 70 bp, Artificial Sequence
  Synthetic
gccaagcatttaggtgacactatagtgttatagtcagtcaaagacgtttcagagctatgctggaaacagc

SEQ ID NO: 69231 - DNA, 70 bp, Artificial Sequence
  Synthetic
gccaagcatttaggtgacactataggccacccactgctaccgttggtttcagagctatgctggaaacagc

SEQ ID NO: 69232 - DNA, 70 bp, Artificial Sequence
  Synthetic
gccaagcatttaggtgacactataggtctgatggagaggaagatggtttcagagctatgctggaaacagc

SEQ ID NO: 69233 - DNA, 70 bp, Artificial Sequence
  Synthetic
gccaagcatttaggtgacactatagaacttgaacgggaaccagaagtttcagagctatgctggaaacagc

SEQ ID NO: 69234 - DNA, 70 bp, Artificial Sequence
  Synthetic
gccaagcatttaggtgacactatagtagtgttttcaccaatcaccgtttcagagctatgctggaaacagc

SEQ ID NO: 69235 - DNA, 70 bp, Artificial Sequence
  Synthetic
gccaagcatttaggtgacactatagatcagacatcacacgattttgtttcagagctatgctggaaacagc

SEQ ID NO: 69236 - DNA, 70 bp, Artificial Sequence
  Synthetic
gccaagcatttaggtgacactatagagtcgtggcaggaggaggtcgtttcagagctatgctggaaacagc

SEQ ID NO: 69237 - DNA, 70 bp, Artificial Sequence
  Synthetic
gccaagcatttaggtgacactatagggcccacggccacatgtgaagtttcagagctatgctggaaacagc

SEQ ID NO: 69238 - DNA, 70 bp, Artificial Sequence
  Synthetic
gccaagcatttaggtgacactatagcgcgagacgctgtactagctgtttcagagctatgctggaaacagc

SEQ ID NO: 69239 - DNA, 70 bp, Artificial Sequence
  Synthetic
gccaagcatttaggtgacactatagcaacatcagactatccacaagtttcagagctatgctggaaacagc

SEQ ID NO: 69240 - DNA, 70 bp, Artificial Sequence
  Synthetic
gccaagcatttaggtgacactataggctgggaaaccacaaaggaagtttcagagctatgctggaaacagc

SEQ ID NO: 69241 - DNA, 70 bp, Artificial Sequence
  Synthetic
gccaagcatttaggtgacactatagaccacaaaggaatggtaagcgtttcagagctatgctggaaacagc

SEQ ID NO: 69242 - DNA, 70 bp, Artificial Sequence
  Synthetic
gccaagcatttaggtgacactatagagagctgaacttactcggaagtttcagagctatgctggaaacagc

SEQ ID NO: 69243 - DNA, 70 bp, Artificial Sequence
  Synthetic
gccaagcatttaggtgacactatagccgcacccccagaggcgcaggtttcagagctatgctggaaacagc

SEQ ID NO: 69244 - DNA, 70 bp, Artificial Sequence
  Synthetic
gccaagcatttaggtgacactatagaaatgccccgagtgtggcaagtttcagagctatgctggaaacagc

SEQ ID NO: 69245 - DNA, 70 bp, Artificial Sequence
  Synthetic
gccaagcatttaggtgacactatagggctgcaactggaatcacacgtttcagagctatgctggaaacagc

SEQ ID NO: 69246 - DNA, 70 bp, Artificial Sequence
  Synthetic
gccaagcatttaggtgacactatagtccagaagttcattacaaacgtttcagagctatgctggaaacagc

SEQ ID NO: 69247 - DNA, 70 bp, Artificial Sequence
  Synthetic
gccaagcatttaggtgacactatagcaggagggaaggcgtcgtaggtttcagagctatgctggaaacagc

SEQ ID NO: 69248 - DNA, 70 bp, Artificial Sequence
  Synthetic
gccaagcatttaggtgacactatagcagcgagtccacactggagagtttcagagctatgctggaaacagc

SEQ ID NO: 69249 - DNA, 70 bp, Artificial Sequence
  Synthetic
gccaagcatttaggtgacactatagcatcacggtgctgcaatgacgtttcagagctatgctggaaacagc

SEQ ID NO: 69250 - DNA, 70 bp, Artificial Sequence
  Synthetic
gccaagcatttaggtgacactatagtcctttggtgctgagtcagggtttcagagctatgctggaaacagc

SEQ ID NO: 69251 - DNA, 70 bp, Artificial Sequence
  Synthetic
gccaagcatttaggtgacactatagagctagcttgattcagccacgtttcagagctatgctggaaacagc

SEQ ID NO: 69252 - DNA, 70 bp, Artificial Sequence
  Synthetic
gccaagcatttaggtgacactatagccccacaggaagacctgaaagtttcagagctatgctggaaacagc

SEQ ID NO: 69253 - DNA, 70 bp, Artificial Sequence
  Synthetic
gccaagcatttaggtgacactatagagacattgtggaagccattcgtttcagagctatgctggaaacagc

SEQ ID NO: 69254 - DNA, 70 bp, Artificial Sequence
  Synthetic
gccaagcatttaggtgacactatagtgctatgctcactgcaccaggtttcagagctatgctggaaacagc

SEQ ID NO: 69255 - DNA, 70 bp, Artificial Sequence
  Synthetic
gccaagcatttaggtgacactatagaaagacaaactggcttgatggtttcagagctatgctggaaacagc

SEQ ID NO: 69256 - DNA, 70 bp, Artificial Sequence
  Synthetic
gccaagcatttaggtgacactatagtatatcctcaggggcttactgtttcagagctatgctggaaacagc

SEQ ID NO: 69257 - DNA, 70 bp, Artificial Sequence
  Synthetic
gccaagcatttaggtgacactatagttacccacagagttaaactcgtttcagagctatgctggaaacagc

SEQ ID NO: 69258 - DNA, 70 bp, Artificial Sequence
  Synthetic
gccaagcatttaggtgacactatagacactggagagagaccataagtttcagagctatgctggaaacagc

SEQ ID NO: 69259 - DNA, 70 bp, Artificial Sequence
  Synthetic
gccaagcatttaggtgacactataggcagtactctcatcacaggagtttcagagctatgctggaaacagc

SEQ ID NO: 69260 - DNA, 70 bp, Artificial Sequence
  Synthetic
gccaagcatttaggtgacactatagccagcagcttaggaagcttcgtttcagagctatgctggaaacagc

SEQ ID NO: 69261 - DNA, 70 bp, Artificial Sequence
  Synthetic
gccaagcatttaggtgacactatagaatcactgagaagtagcttcgtttcagagctatgctggaaacagc

SEQ ID NO: 69262 - DNA, 70 bp, Artificial Sequence
  Synthetic
gccaagcatttaggtgacactatagggacctgactctggaatcacgtttcagagctatgctggaaacagc

SEQ ID NO: 69263 - DNA, 70 bp, Artificial Sequence
  Synthetic
gccaagcatttaggtgacactatagacagtggctgagctggtctagtttcagagctatgctggaaacagc

SEQ ID NO: 69264 - DNA, 70 bp, Artificial Sequence
  Synthetic
gccaagcatttaggtgacactataggcatcgagaataatcagagtgtttcagagctatgctggaaacagc

SEQ ID NO: 69265 - DNA, 70 bp, Artificial Sequence
  Synthetic
gccaagcatttaggtgacactataggtatttacagagtgagacacgtttcagagctatgctggaaacagc

SEQ ID NO: 69266 - DNA, 70 bp, Artificial Sequence
  Synthetic
gccaagcatttaggtgacactatagtaatgcatcacagctgtagcgtttcagagctatgctggaaacagc

SEQ ID NO: 69267 - DNA, 70 bp, Artificial Sequence
  Synthetic
gccaagcatttaggtgacactatagtgcgggagcgttttggttgagtttcagagctatgctggaaacagc

SEQ ID NO: 69268 - DNA, 70 bp, Artificial Sequence
  Synthetic
gccaagcatttaggtgacactatagctgctggtgcgagagcgcttgtttcagagctatgctggaaacagc

SEQ ID NO: 69269 - DNA, 70 bp, Artificial Sequence
  Synthetic
gccaagcatttaggtgacactatagatgttggttcgggagaggttgtttcagagctatgctggaaacagc

SEQ ID NO: 69270 - DNA, 70 bp, Artificial Sequence
  Synthetic
gccaagcatttaggtgacactatagagagacacttagctgctgacgtttcagagctatgctggaaacagc

SEQ ID NO: 69271 - DNA, 70 bp, Artificial Sequence
  Synthetic
gccaagcatttaggtgacactatagcctaagggtgaaagactcaggtttcagagctatgctggaaacagc

SEQ ID NO: 69272 - DNA, 70 bp, Artificial Sequence
  Synthetic
gccaagcatttaggtgacactatagggtggcctctggtatttattgtttcagagctatgctggaaacagc

SEQ ID NO: 69273 - DNA, 70 bp, Artificial Sequence
  Synthetic
gccaagcatttaggtgacactatagggcatgaagggtcagggctcgtttcagagctatgctggaaacagc

SEQ ID NO: 69274 - DNA, 70 bp, Artificial Sequence
  Synthetic
gccaagcatttaggtgacactataggacttgagaagcttgtctccgtttcagagctatgctggaaacagc

SEQ ID NO: 69275 - DNA, 70 bp, Artificial Sequence
  Synthetic
gccaagcatttaggtgacactatagtctttctgtgttctgaaacagtttcagagctatgctggaaacagc

SEQ ID NO: 69276 - DNA, 70 bp, Artificial Sequence
  Synthetic
gccaagcatttaggtgacactatagcacttcacttgaaatgcaccgtttcagagctatgctggaaacagc

SEQ ID NO: 69277 - DNA, 70 bp, Artificial Sequence
  Synthetic
gccaagcatttaggtgacactatagggcaaatttacatctccagcgtttcagagctatgctggaaacagc

SEQ ID NO: 69278 - DNA, 70 bp, Artificial Sequence
  Synthetic
gccaagcatttaggtgacactatagtgtgactggcagctcattttgtttcagagctatgctggaaacagc

SEQ ID NO: 69279 - DNA, 70 bp, Artificial Sequence
  Synthetic
gccaagcatttaggtgacactatagacctgcaggatctgcagtgagtttcagagctatgctggaaacagc

SEQ ID NO: 69280 - DNA, 70 bp, Artificial Sequence
  Synthetic
gccaagcatttaggtgacactatagaggcactggcaacttctattgtttcagagctatgctggaaacagc

SEQ ID NO: 69281 - DNA, 70 bp, Artificial Sequence
  Synthetic
gccaagcatttaggtgacactatagtgaaattccttaggttcagagtttcagagctatgctggaaacagc

SEQ ID NO: 69282 - DNA, 70 bp, Artificial Sequence
  Synthetic
gccaagcatttaggtgacactataggctatcaatttagtctggctgtttcagagctatgctggaaacagc

SEQ ID NO: 69283 - DNA, 70 bp, Artificial Sequence
  Synthetic
gccaagcatttaggtgacactatagggcctgtcctcactcaggtcgtttcagagctatgctggaaacagc

SEQ ID NO: 69284 - DNA, 70 bp, Artificial Sequence
  Synthetic
gccaagcatttaggtgacactatagggccacccgcctctggaatggtttcagagctatgctggaaacagc

SEQ ID NO: 69285 - DNA, 70 bp, Artificial Sequence
  Synthetic
gccaagcatttaggtgacactatagtttccagcaaacagatgacagtttcagagctatgctggaaacagc

SEQ ID NO: 69286 - DNA, 64 bp, Artificial Sequence
  Synthetic
  misc_feature (1)..(1): 5' phosphorylated
  misc_feature (1)..(3): PTO modified oligonucleotide
  misc_feature (21)..(21): N = a or g or c or t/u, unknown, or other
  misc_feature (24)..(24): N = a or g or c or t/u, unknown, or other
  misc_feature (27)..(27): N = a or g or c or t/u, unknown, or other
  misc_feature (30)..(30): N = a or g or c or t/u, unknown, or other
  misc_feature (33)..(33): N = a or g or c or t/u, unknown, or other
  misc_feature (36)..(36): R = g or a
  misc_feature (39)..(39): N = a or g or c or t/u, unknown, or other
  misc_feature (42)..(42): R = g or a
  misc_feature (45)..(45): R = g or a
  misc_feature (48)..(48): Y = t/u or c
  misc_feature (51)..(51): Y = t/u or c
  misc_feature (54)..(54): N = a or g or c or t/u, unknown, or other
  misc_feature (57)..(57): N = a or g or c or t/u, unknown, or other
  misc_feature (60)..(60): N = a or g or c or t/u, unknown, or other
ggctctggtggcagtggaggnggntcngtntcnaarggngargargayaaygcntcnctnccag

SEQ ID NO: 69287 - DNA, 65 bp, Artificial Sequence
  Synthetic
  misc_feature (1)..(1): 5' phosphorylated
  misc_feature (1)..(3): PTO modified oligonucleotide
  misc_feature (22)..(22): N = a or g or c or t/u, unknown, or other
  misc_feature (25)..(25): N = a or g or c or t/u, unknown, or other
  misc_feature (28)..(28): N = a or g or c or t/u, unknown, or other
  misc_feature (31)..(31): N = a or g or c or t/u, unknown, or other
  misc_feature (34)..(34): N = a or g or c or t/u, unknown, or other
  misc_feature (37)..(37): R = g or a
  misc_feature (40)..(40): N = a or g or c or t/u, unknown, or other
  misc_feature (43)..(43): R = g or a
  misc_feature (46)..(46): R = g or a
  misc_feature (49)..(49): Y = t/u or c
  misc_feature (52)..(52): Y = t/u or c
  misc_feature (55)..(55): N = a or g or c or t/u, unknown, or other
  misc_feature (58)..(58): N = a or g or c or t/u, unknown, or other
  misc_feature (61)..(61): N = a or g or c or t/u, unknown, or other
cggctctggtggcagtggaggnggntcngtntcnaarggngargargayaaygcntcnctnccag

SEQ ID NO: 69288 - DNA, 66 bp, Artificial Sequence
  Synthetic
  misc_feature (1)..(1): 5' phosphorylated
  misc_feature (1)..(3): PTO modified oligonucleotide
  misc_feature (23)..(23): N = a or g or c or t/u, unknown, or other
  misc_feature (26)..(26): N = a or g or c or t/u, unknown, or other
  misc_feature (29)..(29): N = a or g or c or t/u, unknown, or other
  misc_feature (32)..(32): N = a or g or c or t/u, unknown, or other
  misc_feature (35)..(35): N = a or g or c or t/u, unknown, or other
  misc_feature (38)..(38): R = g or a
  misc_feature (41)..(41): N = a or g or c or t/u, unknown, or other
  misc_feature (44)..(44): R = g or a
  misc_feature (47)..(47): R = g or a
  misc_feature (50)..(50): Y = t/u or c
  misc_feature (53)..(53): Y = t/u or c
  misc_feature (56)..(56): N = a or g or c or t/u, unknown, or other
  misc_feature (59)..(59): N = a or g or c or t/u, unknown, or other
  misc_feature (62)..(62): N = a or g or c or t/u, unknown, or other
gcggctctggtggcagtggaggnggntcngtntcnaarggngargargayaaygcntcnctnccag

SEQ ID NO: 69289 - DNA, 26 bp, Artificial Sequence
  Synthetic
  misc_feature (1)..(1): 5' phosphorylated
  misc_feature (1)..(2): PTO modified oligonucleotide
ttatcagaagaactcgtcaagaaggc

SEQ ID NO: 69290 - DNA, 34 bp, Artificial Sequence
  Synthetic
gtctcgtgggctcggagatgtgtataagagacag

SEQ ID NO: 69291 - DNA, 14 bp, Artificial Sequence
  Synthetic
  misc_feature (1)..(1): 5' phosphorylated
  misc_feature (14)..(14): 3' Dideoxy-C modification
ctgtctcttataca

SEQ ID NO: 69292 - DNA, 23 bp, Artificial Sequence
  Synthetic
ccgttgatggagccaaagatgtg

SEQ ID NO: 69293 - DNA, 93 bp, Artificial Sequence
  Synthetic
aatgatacggcgaccaccgagatctacactatagcctacactctttccctacacgacgctcttccgatctatgtgtaactcatgtgtcgctgg

SEQ ID NO: 69294 - DNA, 93 bp, Artificial Sequence
  Synthetic
aatgatacggcgaccaccgagatctacacatagaggcacactctttccctacacgacgctcttccgatctatgtgtaactcatgtgtcgctgg

SEQ ID NO: 69295 - DNA, 55 bp, Artificial Sequence
  Synthetic
caagcagaagacggcatacgagatcgagtaatgtctcgtgggctcggagatgtgt

SEQ ID NO: 69296 - DNA, 55 bp, Artificial Sequence
  Synthetic
caagcagaagacggcatacgagattctccggagtctcgtgggctcggagatgtgt

SEQ ID NO: 69297 - DNA, 55 bp, Artificial Sequence
  Synthetic
caagcagaagacggcatacgagataatgagcggtctcgtgggctcggagatgtgt

SEQ ID NO: 69298 - DNA, 55 bp, Artificial Sequence
  Synthetic
caagcagaagacggcatacgagatggaatctcgtctcgtgggctcggagatgtgt

SEQ ID NO: 69299 - DNA, 55 bp, Artificial Sequence
  Synthetic
caagcagaagacggcatacgagatttctgaatgtctcgtgggctcggagatgtgt

SEQ ID NO: 69300 - DNA, 55 bp, Artificial Sequence
  Synthetic
caagcagaagacggcatacgagatacgaattcgtctcgtgggctcggagatgtgt

SEQ ID NO: 69301 - DNA, 55 bp, Artificial Sequence
  Synthetic
caagcagaagacggcatacgagatagcttcaggtctcgtgggctcggagatgtgt

SEQ ID NO: 69302 - DNA, 55 bp, Artificial Sequence
  Synthetic
caagcagaagacggcatacgagatgcgcattagtctcgtgggctcggagatgtgt

SEQ ID NO: 69303 - DNA, 55 bp, Artificial Sequence
  Synthetic
caagcagaagacggcatacgagatcatagccggtctcgtgggctcggagatgtgt

SEQ ID NO: 69304 - DNA, 55 bp, Artificial Sequence
  Synthetic
caagcagaagacggcatacgagatttcgcggagtctcgtgggctcggagatgtgt

SEQ ID NO: 69305 - DNA, 55 bp, Artificial Sequence
  Synthetic
caagcagaagacggcatacgagatgcgcgagagtctcgtgggctcggagatgtgt

SEQ ID NO: 69306 - DNA, 55 bp, Artificial Sequence
  Synthetic
caagcagaagacggcatacgagatctatcgctgtctcgtgggctcggagatgtgt

SEQ ID NO: 69307 - DNA, 56 bp, Artificial Sequence
  Synthetic
acactctttccctacacgacgctcttccgatctgatgtgtaactcatgtgtcgctg

SEQ ID NO: 69308 - DNA, 54 bp, Artificial Sequence
  Synthetic
tgactggagttcagacgtgtgctcttccgatctcggctctggtggcagtggagg

SEQ ID NO: 69309 - DNA, 60 bp, Artificial Sequence
  Synthetic
aatgatacggcgaccaccgagatctacactatagcctacactctttccctacacgacgct

SEQ ID NO: 69310 - DNA, 60 bp, Artificial Sequence
  Synthetic
aatgatacggcgaccaccgagatctacacatagaggcacactctttccctacacgacgct

SEQ ID NO: 69311 - DNA, 60 bp, Artificial Sequence
  Synthetic
aatgatacggcgaccaccgagatctacaccctatcctacactctttccctacacgacgct

SEQ ID NO: 69312 - DNA, 60 bp, Artificial Sequence
  Synthetic
aatgatacggcgaccaccgagatctacacggctctgaacactctttccctacacgacgct

SEQ ID NO: 69313 - DNA, 60 bp, Artificial Sequence
  Synthetic
aatgatacggcgaccaccgagatctacacaggcgaagacactctttccctacacgacgct

SEQ ID NO: 69314 - DNA, 60 bp, Artificial Sequence
  Synthetic
aatgatacggcgaccaccgagatctacactaatcttaacactctttccctacacgacgct

SEQ ID NO: 69315 - DNA, 60 bp, Artificial Sequence
  Synthetic
aatgatacggcgaccaccgagatctacaccaggacgtacactctttccctacacgacgct

SEQ ID NO: 69316 - DNA, 60 bp, Artificial Sequence
  Synthetic
aatgatacggcgaccaccgagatctacacgtactgacacactctttccctacacgacgct

SEQ ID NO: 69317 - DNA, 56 bp, Artificial Sequence
  Synthetic
caagcagaagacggcatacgagatcgagtaatgtgactggagttcagacgtgtgct

SEQ ID NO: 69318 - DNA, 56 bp, Artificial Sequence
  Synthetic
caagcagaagacggcatacgagattctccggagtgactggagttcagacgtgtgct

SEQ ID NO: 69319 - DNA, 56 bp, Artificial Sequence
  Synthetic
caagcagaagacggcatacgagataatgagcggtgactggagttcagacgtgtgct

SEQ ID NO: 69320 - DNA, 56 bp, Artificial Sequence
  Synthetic
caagcagaagacggcatacgagatggaatctcgtgactggagttcagacgtgtgct

SEQ ID NO: 69321 - DNA, 56 bp, Artificial Sequence
  Synthetic
caagcagaagacggcatacgagatttctgaatgtgactggagttcagacgtgtgct

SEQ ID NO: 69322 - DNA, 56 bp, Artificial Sequence
  Synthetic
caagcagaagacggcatacgagatacgaattcgtgactggagttcagacgtgtgct

SEQ ID NO: 69323 - DNA, 56 bp, Artificial Sequence
  Synthetic
caagcagaagacggcatacgagatagcttcaggtgactggagttcagacgtgtgct

SEQ ID NO: 69324 - DNA, 56 bp, Artificial Sequence
  Synthetic
caagcagaagacggcatacgagatgcgcattagtgactggagttcagacgtgtgct

SEQ ID NO: 69325 - DNA, 56 bp, Artificial Sequence
  Synthetic
caagcagaagacggcatacgagatcatagccggtgactggagttcagacgtgtgct

SEQ ID NO: 69326 - DNA, 56 bp, Artificial Sequence
  Synthetic
caagcagaagacggcatacgagatttcgcggagtgactggagttcagacgtgtgct

SEQ ID NO: 69327 - DNA, 56 bp, Artificial Sequence
  Synthetic
caagcagaagacggcatacgagatgcgcgagagtgactggagttcagacgtgtgct

SEQ ID NO: 69328 - DNA, 56 bp, Artificial Sequence
  Synthetic
caagcagaagacggcatacgagatctatcgctgtgactggagttcagacgtgtgct

SEQ ID NO: 69329 - DNA, 23 bp, Artificial Sequence
  Synthetic
cggtgaggaggccgaagaggagg

SEQ ID NO: 69330 - DNA, 23 bp, Artificial Sequence
  Synthetic
aggggaggaggaggaagaggagg

SEQ ID NO: 69331 - DNA, 23 bp, Artificial Sequence
  Synthetic
ggaggaggaggacggagaggagg

SEQ ID NO: 69332 - DNA, 54 bp, Artificial Sequence
  Synthetic
  misc_feature (1)..(1): 5' phosphorylated
  misc_feature (1)..(2): PTO modified oligonucleotide
  misc_feature (6)..(6): H = a or c or t/u
  misc_feature (9)..(9): N = a or g or c or t/u, unknown, or other
  misc_feature (12)..(12): N = a or g or c or t/u, unknown, or other
  misc_feature (15)..(15): N = a or g or c or t/u, unknown, or other
  misc_feature (18)..(18): Y = t/u or c
  misc_feature (21)..(21): N = a or g or c or t/u, unknown, or other
  misc_feature (24)..(24): N = a or g or c or t/u, unknown, or other
  misc_feature (27)..(27): N = a or g or c or t/u, unknown, or other
  misc_feature (30)..(30): N = a or g or c or t/u, unknown, or other
ggcgghtcnggnggnagyggnggnggntcngtgagcaagggcgaggaggataac

SEQ ID NO: 69333 - protein, 9 aa, Artificial Sequence
  Synthetic
GSGGSGGGS

SEQ ID NO: 69334 - DNA, 53 bp, Artificial Sequence
  Synthetic
  misc_feature (1)..(1): 5' phosphorylated
  misc_feature (1)..(2): PTO modified oligonucleotide
  misc_feature (5)..(5): N = a or g or c or t/u, unknown, or other
  misc_feature (8)..(8): N = a or g or c or t/u, unknown, or other
  misc_feature (11)..(11): N = a or g or c or t/u, unknown, or other
  misc_feature (14)..(14): N = a or g or c or t/u, unknown, or other
  misc_feature (17)..(17): Y = t/u or c
  misc_feature (20)..(20): N = a or g or c or t/u, unknown, or other
  misc_feature (23)..(23): N = a or g or c or t/u, unknown, or other
  misc_feature (26)..(26): N = a or g or c or t/u, unknown, or other
  misc_feature (29)..(29): N = a or g or c or t/u, unknown, or other
gcggntcnggnggnagyggnggnggntcngtgagcaagggcgaggaggataac

SEQ ID NO: 69335 - DNA, 52 bp, Artificial Sequence
  Synthetic
  misc_feature (1)..(1): 5' phosphorylated
  misc_feature (1)..(2): PTO modified oligonucleotide
  misc_feature (4)..(4): N = a or g or c or t/u, unknown, or other
  misc_feature (7)..(7): N = a or g or c or t/u, unknown, or other
  misc_feature (10)..(10): N = a or g or c or t/u, unknown, or other
  misc_feature (13)..(13): N = a or g or c or t/u, unknown, or other
  misc_feature (16)..(16): Y = t/u or c
  misc_feature (19)..(19): N = a or g or c or t/u, unknown, or other
  misc_feature (22)..(22): N = a or g or c or t/u, unknown, or other
  misc_feature (25)..(25): N = a or g or c or t/u, unknown, or other
  misc_feature (28)..(28): N = a or g or c or t/u, unknown, or other
cggntcnggnggnagyggnggnggntcngtgagcaagggcgaggaggataac

SEQ ID NO: 69336 - DNA, 66 bp, Artificial Sequence
  Synthetic
  misc_feature (1)..(1): 5' phosphorylated
  misc_feature (1)..(3): PTO modified oligonucleotide
  misc_feature (24)..(24): N = a or g or c or t/u, unknown, or other
  misc_feature (27)..(27): N = a or g or c or t/u, unknown, or other
  misc_feature (30)..(30): N = a or g or c or t/u, unknown, or other
  misc_feature (33)..(33): N = a or g or c or t/u, unknown, or other
  misc_feature (36)..(36): N = a or g or c or t/u, unknown, or other
  misc_feature (39)..(39): R = g or a
  misc_feature (42)..(42): N = a or g or c or t/u, unknown, or other
  misc_feature (45)..(45): R = g or a
  misc_feature (48)..(48): R = g or a
  misc_feature (51)..(51): Y = t/u or c
  misc_feature (53)..(53): Y = t/u or c
  misc_feature (56)..(56): N = a or g or c or t/u, unknown, or other
  misc_feature (59)..(59): N = a or g or c or t/u, unknown, or other
  misc_feature (62)..(62): N = a or g or c or t/u, unknown, or other
ggcggctctggtggcagtggaggnggntcngtntcnaarggngargargayaygcntcnctnccag

SEQ ID NO: 69337 - DNA, 65 bp, Artificial Sequence; identical to SEQ ID NO: 69287
  Synthetic
  misc_feature (1)..(1): 5' phosphorylated
  misc_feature (1)..(3): PTO modified oligonucleotide
  misc_feature (22)..(22): N = a or g or c or t/u, unknown, or other
  misc_feature (25)..(25): N = a or g or c or t/u, unknown, or other
  misc_feature (28)..(28): N = a or g or c or t/u, unknown, or other
  misc_feature (31)..(31): N = a or g or c or t/u, unknown, or other
  misc_feature (34)..(34): N = a or g or c or t/u, unknown, or other
  misc_feature (37)..(37): R = g or a
  misc_feature (40)..(40): N = a or g or c or t/u, unknown, or other
  misc_feature (43)..(43): R = g or a
  misc_feature (46)..(46): R = g or a
  misc_feature (49)..(49): Y = t/u or c
  misc_feature (52)..(52): Y = t/u or c
  misc_feature (55)..(55): N = a or g or c or t/u, unknown, or other
  misc_feature (58)..(58): N = a or g or c or t/u, unknown, or other
  misc_feature (61)..(61): N = a or g or c or t/u, unknown, or other

SEQ ID NO: 69338 - DNA, 66 bp, Artificial Sequence; identical to SEQ ID NO: 69288
  Synthetic
  misc_feature (1)..(1): 5' phosphorylated
  misc_feature (1)..(3): PTO modified oligonucleotide
  misc_feature (23)..(23): N = a or g or c or t/u, unknown, or other
  misc_feature (26)..(26): N = a or g or c or t/u, unknown, or other
  misc_feature (29)..(29): N = a or g or c or t/u, unknown, or other
  misc_feature (32)..(32): N = a or g or c or t/u, unknown, or other
  misc_feature (35)..(35): N = a or g or c or t/u, unknown, or other
  misc_feature (38)..(38): R = g or a
  misc_feature (41)..(41): N = a or g or c or t/u, unknown, or other
  misc_feature (44)..(44): R = g or a
  misc_feature (47)..(47): R = g or a
  misc_feature (50)..(50): Y = t/u or c
  misc_feature (53)..(53): Y = t/u or c
  misc_feature (56)..(56): N = a or g or c or t/u, unknown, or other
  misc_feature (59)..(59): N = a or g or c or t/u, unknown, or other
  misc_feature (62)..(62): N = a or g or c or t/u, unknown, or other

SEQ ID NO: 69339 - protein, 6 aa, Artificial Sequence
  Synthetic
SIGIRR

SEQ ID NO: 69340 - DNA, 18 bp, Artificial Sequence
  Synthetic
  misc_feature (3)..(3): N = a or g or c or t/u, unknown, or other
  misc_feature (6)..(6): N = a or g or c or t/u, unknown, or other
  misc_feature (9)..(9): R = g or a
  misc_feature (12)..(12): N = a or g or c or t/u, unknown, or other
  misc_feature (15)..(15): R = g or a
  misc_feature (18)..(18): R = g or a
gtntcnaarggngargar

SEQ ID NO: 69341 - DNA, 4228 bp, Artificial Sequence
  Synthetic
aataaaatatctttattttcattacatctgtgtgttggttttttgtgtgaatcgatagtactaacatacgctctccatcaaaacaaaacgaaacaaaacaaactagcaaaataggctgtccccagtgcaagtgcaggtgccagaacatttctcttaatgatagctagcgggccagtacccaaaaagcggggggtctggtggcagtggagggggatccgtgagcaagggcgaggaggataacgcctctctcccagcgacacatgagttacacatctttggctccatcaacggtgtggactttgacatggtgggtcagggcaccggcaatccaaatgatggttatgaggagttaaacctgaagtccaccaagggtgacctccagttctccccctggattctggtccctcatatcgggtatggcttccatcagtacctgccctaccctgacgggatgtcgcctttccaggccgccatggtagatggctccggataccaagtccatcgcacaatgcagtttgaagatggtgcctcccttactgttaactaccgctacacctacgagggaagccacatcaaaggagaggcccaggtgaaggggactggtttccctgctgacggtcctgtgatgaccaactcgctgaccgctgcggactggtgcaggtcgaagaagacttaccccaacgacaaaaccatcatcagtacctttaagtggagttacaccactggaaatggcaagcgctaccggagcactgcgcggaccacctacacctttgccaagccaatggcggctaactatctgaagaaccagccgatgtacgtgttccgtaagacggagctcaagcactccaagaccgagctcaacttcaaggagtggcaaaaggcctttaccgatgtgatgggcatggacgagctgtacaagcccggggattacaaagatgacgatgacaaagattataaggatgacgatgataaggactataaagacgacgatgataaagaaaacctgtacttccagagcgagcaaaagctcatcagcgaggaagatctgggtaccggttccggagagggcagaggaagtctgctaacatgcggtgacgtcgaggagaatcctggcccaatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagggcccgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtaaaatcgataaagatccgtcgaccgatgcccttgagagccttcaacccagtcagctccttccggtgggcgcggggcatgactatcgtcgccgcacttatgactgtcttctttatcatgcaactcgtaggacaggtgccggcagcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagcggccgcaaatgctaaaccactgcagtggttaccagtgcttgatcagtgaggcaccgatctcagcgatctgcctatttcgttcgtccatagtggcctgactccccgtcgtgtagatcactacgattcgtgagggcttaccatcaggccccagcgcagcaatgatgccgcgagagccgcgttcaccggcccccgatttgtcagcaatgaaccagccagcagggagggccgagcgaagaagtggtcctgctactttgtccgcctccatccagtctatgagctgctgtcgtgatgctagagtaagaagttcgccagtgagtagtttccgaagagttgtggccattgctactggcatcgtggtatcacgctcgtcgttcggtatggcttcgttcaactctggttcccagcggtcaagccgggtcacatgatcacccatattatgaagaaatgcagtcagctccttagggcctccgatcgttgtcagaagtaagttggccgcggtgttgtcgctcatggtaatggcagcactacacaattctcttaccgtcatgccatccgtaagatgcttttccgtgaccggcgagtactcaaccaagtcgttttgtgagtagtgtatacggcgaccaagctgctcttgcccggcgtctatacgggacaacaccgcgccacatagcagtactttgaaagtgctcatcatcgggaatcgttcttcggggcggaaagactcaaggatcttgccgctattgagatccagttcgatatagcccactcttgcacccagttgatcttcagcatcttttactttcaccagcgtttcggggtgtgcaaaaacaggcaagcaaaatgccgcaaagaagggaatgagtgcgacacgaaaatgttggatgctcatactcgtcctttttcaatattattgaagcatttatcagggttactagtacgtctctcaaggataagtaagtaatattaaggtacgggaggtattggacaggccgc
